(12) United States Patent
Liu et al.

(10) Patent No.: US 11,795,443 B2
(45) Date of Patent: Oct. 24, 2023

(54) USES OF ADENOSINE BASE EDITORS

(71) Applicants: The Broad Institute, Inc., Cambridge, MA (US); President and Fellows of Harvard College, Cambridge, MA (US); Beam Therapeutics Inc., Cambridge, MA (US)

(72) Inventors: David R. Liu, Cambridge, MA (US); Nicole Marie Gaudelli, Cambridge, MA (US); Michael S. Packer, Cambridge, MA (US); Gregory Newby, Cambridge, MA (US)

(73) Assignees: The Broad Institute, Inc., Cambridge, MA (US); President and Fellows of Harvard College, Cambridge, MA (US); Beam Therapeutics, Inc., Cambridge, MA (US)

( * ) Notice: Subject to any disclaimer, the term of this patent is extended or adjusted under 35 U.S.C. 154(b) by 179 days.

(21) Appl. No.: 16/756,432

(22) PCT Filed: Oct. 16, 2018

(86) PCT No.: PCT/US2018/056146
§ 371 (c)(1),
(2) Date: Apr. 15, 2020

(87) PCT Pub. No.: WO2019/079347
PCT Pub. Date: Apr. 25, 2019

(65) Prior Publication Data
US 2020/0399626 A1    Dec. 24, 2020

Related U.S. Application Data

(60) Provisional application No. 62/573,127, filed on Oct. 16, 2017.

(51) Int. Cl.
| | |
|---|---|
| *C12N 9/78* | (2006.01) |
| *C12N 9/22* | (2006.01) |
| *C12N 15/11* | (2006.01) |
| *A61K 38/00* | (2006.01) |

(52) U.S. Cl.
CPC ............... *C12N 9/78* (2013.01); *C12N 9/22* (2013.01); *C12N 15/11* (2013.01); *C12Y 305/04004* (2013.01); *A61K 38/00* (2013.01); *C07K 2319/00* (2013.01); *C12N 2310/20* (2017.05); *C12N 2800/80* (2013.01)

(58) Field of Classification Search
CPC ...................................................... C12N 9/78
See application file for complete search history.

(56) References Cited

U.S. PATENT DOCUMENTS

| 4,182,449 A | 1/1980 | Kozlow |
|---|---|---|
| 4,186,183 A | 1/1980 | Steck et al. |
| 4,217,344 A | 8/1980 | Vanlerberghe et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,663,290 A | 5/1987 | Weis et al. |
| 4,737,323 A | 4/1988 | Martin et al. |
| 4,774,085 A | 9/1988 | Fidler |
| 4,797,368 A | 1/1989 | Carter et al. |
| 4,837,028 A | 6/1989 | Allen |
| 4,873,316 A | 10/1989 | Meade et al. |
| 4,880,635 A | 11/1989 | Janoff et al. |
| 4,889,818 A | 12/1989 | Gelfand et al. |
| 4,897,355 A | 1/1990 | Eppstein et al. |
| 4,906,477 A | 3/1990 | Kurono et al. |
| 4,911,928 A | 3/1990 | Wallach |

(Continued)

FOREIGN PATENT DOCUMENTS

| AU | 2012244264 A1 | 11/2012 |
|---|---|---|
| AU | 2012354062 A1 | 7/2014 |

(Continued)

OTHER PUBLICATIONS

[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C->U editing enzyme APOBEC-1 [Peromyscus maniculatus bairdii], XP002793540. Mar. 21, 2016.
[No Author Listed] NCBI Accession No. XP_021505673.1. C->U editing enzyme APOBEC-1 [Meriones unguiculatus], XP002793541. Jun. 27, 2017.
[No Author Listed] NCBI Reference Sequence: WP_00087959824. 1. Oct. 9, 2019. 2 pages.

(Continued)

*Primary Examiner* — Suzanne M Noakes
(74) *Attorney, Agent, or Firm* — Wolf, Greenfield & Sacks, P.C.

(57) ABSTRACT

The disclosure provides methods and compositions for treating blood diseases/disorders, such as sickle cell disease, hemochromatosis, hemophilia, and beta-thalassemia. For example the disclosure provides therapeutic guide RNAs that target the promotor of HBG1/2 to generate point mutations that increase expression of fetal hemoglobin. As another example, the disclosure provides therapeutic guide RNAs that target mutations in HBB, Factor VIII, and HFE to treat sickle cell disease, beta-thalassemia, hemophilia and hemochromatosis. The disclosure also provides fusion proteins comprising a Cas9 (e.g., a Cas9 nickase) domain and adenosine deaminases that deaminate adenosine in DNA. In some embodiments, the fusion proteins are in complex with nucleic acids, such as guide RNAs (gRNAs), which target the fusion proteins to a DNA sequence (e.g., an HBG1 or HBG2 protmoter sequence, or an HFE, GBB, or F8 gene sequence). Such complexes may be useful for increasing expression of fetal hemoglobin or correcting a poing mutation (e.g., C282Y) in HFE.

39 Claims, 58 Drawing Sheets

Specification includes a Sequence Listing.

(56) References Cited

U.S. PATENT DOCUMENTS

| | | |
|---|---|---|
| 4,917,951 A | 4/1990 | Wallach |
| 4,920,016 A | 4/1990 | Allen et al. |
| 4,921,757 A | 5/1990 | Wheatley et al. |
| 4,946,787 A | 8/1990 | Eppstein et al. |
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,962,313 A | 10/1999 | Podsakoff et al. |
| 5,981,182 A | 11/1999 | Jacobs, Jr. et al. |
| 6,015,794 A | 1/2000 | Haseloff et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,067,650 B1 | 6/2006 | Tanaka |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,846,578 B2 | 9/2014 | McCray et al. |
| 8,889,418 B2 | 11/2014 | Zhang et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,784 B2 | 12/2016 | Liu et al. |

(56) References Cited

U.S. PATENT DOCUMENTS

| | | |
|---|---|---|
| 9,534,210 B2 | 1/2017 | Park et al. |
| 9,580,698 B1 | 2/2017 | Xu et al. |
| 9,610,322 B2 | 4/2017 | Liu et al. |
| 9,637,739 B2 | 5/2017 | Siksnys et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,474 B2 | 9/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,640,767 B2 | 5/2020 | Maianti et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,447,770 B1 | 9/2022 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0015238 A1 | 1/2007 | Snyder et al. |
| 2007/0264692 A1 | 11/2007 | Liu et al. |
| 2007/0269817 A1 | 11/2007 | Shapero |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |

(56) References Cited

U.S. PATENT DOCUMENTS

| | | |
|---|---|---|
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1 | 9/2017 | Barrangou et al. |
| 2017/0275665 A1 | 9/2017 | Silas et al. |
| 2017/0283797 A1 | 10/2017 | Robb et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |

(56) References Cited

U.S. PATENT DOCUMENTS

| | | |
|---|---|---|
| 2018/0236081 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0346927 A1 | 12/2018 | Doudna et al. |
| 2018/0371497 A1 | 12/2018 | Gill et al. |
| 2019/0010481 A1 | 1/2019 | Joung et al. |
| 2019/0055543 A1 | 2/2019 | Tran et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0309290 A1 | 10/2019 | Neuteboom et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0238182 A1 | 7/2022 | Shen et al. |
| 2022/0249697 A1 | 8/2022 | Liu et al. |
| 2022/0282275 A1 | 9/2022 | Liu et al. |

FOREIGN PATENT DOCUMENTS

| | | |
|---|---|---|
| AU | 2015252023 A1 | 11/2015 |
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2852593 A1 | 11/2015 |
| CN | 1069962 A | 3/1993 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |

(56) References Cited

FOREIGN PATENT DOCUMENTS

| | | | |
|---|---|---|---|
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105934516 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |

(56) References Cited

FOREIGN PATENT DOCUMENTS

| | | | |
|---|---|---|---|
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |

(56) References Cited

FOREIGN PATENT DOCUMENTS

| | | |
|---|---|---|
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 109517841 A | 3/2019 |
| EP | 264166 A1 | 4/1988 |
| EP | 0321201 B2 | 6/1989 |
| EP | 0519463 A1 | 12/1992 |
| EP | 2604255 A1 | 6/2013 |
| EP | 2840140 A1 | 2/2015 |
| EP | 2877490 A2 | 6/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3 115 457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2528177 A | 1/2016 |
| GB | 2531454 A | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |
| JP | 2016-525888 A | 9/2016 |
| JP | 2016-534132 A | 11/2016 |
| JP | 2017-500035 A | 1/2017 |
| JP | 6633524 B2 | 1/2020 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 | 1/2017 |
| SG | 10201710486 | 10/2018 |
| SG | 10201710487 | 10/2018 |
| SG | 10201710488 | 10/2018 |
| TW | 1608100 B | 12/2017 |
| TW | 2018-29773 A | 8/2018 |
| WO | WO 1990/002809 | 3/1990 |
| WO | WO 1991/003162 A1 | 3/1991 |
| WO | WO 1991/016024 A1 | 10/1991 |
| WO | WO 1991/017271 A1 | 11/1991 |
| WO | WO 1991/017424 A1 | 11/1991 |
| WO | WO 1992/006188 A2 | 4/1992 |
| WO | WO 1992/006200 A1 | 4/1992 |
| WO | WO 1992/007065 A1 | 4/1992 |
| WO | WO 1993/015187 A1 | 8/1993 |
| WO | WO 1993/024641 A2 | 12/1993 |
| WO | WO 1994/018316 A2 | 8/1994 |
| WO | WO 1994/026877 A1 | 11/1994 |
| WO | WO 1996/004403 A1 | 2/1996 |
| WO | WO 1996/010640 A1 | 4/1996 |
| WO | WO 1998/032845 A1 | 7/1998 |
| WO | WO 2001/036452 A2 | 5/2001 |

(56) References Cited

FOREIGN PATENT DOCUMENTS

| | | |
|---|---|---|
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 0514791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/066923 A1 | 6/2007 |
| WO | WO 2007/136815 A2 | 11/2007 |
| WO | WO 2007/143574 A1 | 12/2007 |
| WO | WO 2008/005529 A2 | 1/2008 |
| WO | WO 2008/108989 A2 | 9/2008 |
| WO | WO 2009/098290 A1 | 8/2009 |
| WO | WO 2009/134808 A2 | 11/2009 |
| WO | WO 2010/011961 A2 | 1/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A1 | 12/2012 |
| WO | WO 2013/012674 A1 | 1/2013 |
| WO | WO 2013/013105 A1 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A1 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A1 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A1 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |

(56) References Cited

FOREIGN PATENT DOCUMENTS

| | | |
|---|---|---|
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A2 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/095804 A1 | 6/2015 |
| WO | WO 2015/099850 A1 | 7/2015 |

(56) References Cited

FOREIGN PATENT DOCUMENTS

| | | |
|---|---|---|
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A1 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |

(56) References Cited

FOREIGN PATENT DOCUMENTS

| | | |
|---|---|---|
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 | 6/2016 |
| WO | WO 2016/100974 A1 | 6/2016 |
| WO | WO 2016/103233 | 6/2016 |
| WO | WO 2016/104716 | 6/2016 |
| WO | WO 2016/106236 A1 | 6/2016 |
| WO | WO 2016/106239 | 6/2016 |
| WO | WO 2016/106244 A1 | 6/2016 |
| WO | WO 2016/106338 | 6/2016 |
| WO | WO 2016/108926 | 7/2016 |
| WO | WO 2016/109255 A1 | 7/2016 |
| WO | WO 2016/109840 | 7/2016 |
| WO | WO 2016/110214 | 7/2016 |
| WO | WO 2016/110453 | 7/2016 |
| WO | WO 2016/110511 | 7/2016 |
| WO | WO 2016/110512 | 7/2016 |
| WO | WO 2016/111546 | 7/2016 |
| WO | WO 2016/112242 | 7/2016 |
| WO | WO 2016/112351 | 7/2016 |
| WO | WO 2016/112963 | 7/2016 |
| WO | WO 2016/112963 A1 | 7/2016 |
| WO | WO 2016/113357 | 7/2016 |
| WO | WO 2016/114972 A1 | 7/2016 |
| WO | WO 2016/115179 | 7/2016 |
| WO | WO 2016/115326 A1 | 7/2016 |
| WO | WO 2016/115355 A1 | 7/2016 |
| WO | WO 2016/116032 | 7/2016 |
| WO | WO 2016/120480 | 8/2016 |
| WO | WO 2016/123071 | 8/2016 |
| WO | WO 2016/123230 | 8/2016 |
| WO | WO 2016/123243 A1 | 8/2016 |
| WO | WO 2016/123578 | 8/2016 |
| WO | WO 2016/126747 | 8/2016 |
| WO | WO 2016/130600 A2 | 8/2016 |
| WO | WO 2016/130697 | 8/2016 |
| WO | WO 2016/131009 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |

(56) References Cited

FOREIGN PATENT DOCUMENTS

| | | |
|---|---|---|
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A1 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |

(56) References Cited

FOREIGN PATENT DOCUMENTS

| | | |
|---|---|---|
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |

(56) References Cited

FOREIGN PATENT DOCUMENTS

| | | |
|---|---|---|
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A2 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A2 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/051097 A1 | 3/2019 |
| WO | WO 2019/079347 A1 | 4/2019 |
| WO | WO 2019/084062 A1 | 5/2019 |
| WO | WO 2019/090367 A1 | 5/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/217942 A1 | 11/2019 |
| WO | WO 2019/226953 A1 | 11/2019 |
| WO | WO 2019/236566 A1 | 12/2019 |
| WO | WO 2020/014261 A1 | 1/2020 |
| WO | WO 2020/028555 A2 | 2/2020 |
| WO | WO 2020/028823 A1 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/157008 A1 | 8/2020 |
| WO | WO 2020/160071 A1 | 8/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A2 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |

(56) References Cited

FOREIGN PATENT DOCUMENTS

| WO | WO 2020/210751 A1 | 10/2020 |
|----|-------------------|---------|
| WO | WO 2020/214842 A1 | 10/2020 |
| WO | WO 2020/236982 A1 | 11/2020 |
| WO | WO 2021/025750 A1 | 2/2021 |
| WO | WO 2021/030666 A1 | 2/2021 |
| WO | WO 2021/072328 A1 | 4/2021 |
| WO | WO 2021/108717 A2 | 6/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/222318 A1 | 11/2021 |
| WO | WO 2021/226558 A1 | 11/2021 |

OTHER PUBLICATIONS

[No Author Listed] Score result for SEQ 355 to W02017032580. Muir et al. 2016.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Aihara et al., A conformational switch controls the DNA cleavage activity of lambda integrase. Mol Cell. Jul. 2003;12(1):187-98.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with No. detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akopian et al., Chimeric recombinases with designed DNA sequence recognition. Proc Natl Acad Sci U S A. Jul. 22, 2003;100(15):8688-91. Epub Jul. 1, 2003.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known Y-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science.1589762.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.

(56) References Cited

OTHER PUBLICATIONS

Araki et al., Site-specific recombinase, R, encoded by yeast plasmid pSR1. J Mol Biol. May 5, 1992;225(1):25-37. doi: 10.1016/0022-2836(92)91023-i.

Araki et al., Targeted integration of DNA using mutant lox sites in embryonic stem cells. Nucleic Acids Res. Feb. 15, 1997;25(4):868-72. doi: 10.1093/nar/25.4.868.

Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.

Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.

Arbab et al., Cloning-free CRISPR. Stem Cell Reports. Nov. 10, 2015;5(5):908-917. doi: 10.1016/j.stemcr.2015.09.022. Epub Oct. 29, 2015.

Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.

Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.

Arnold et al., Mutants of Tn3 resolvase which do not require accessory binding sites for recombination activity. EMBO J. Mar. 1, 1999;18(5):1407-14.

Asante et al., A naturally occurring variant of the human prion protein completely prevents prion disease. Nature. Jun. 25, 2015;522(7557):478-81. doi: 10.1038/nature14510. Epub Jun. 10, 2015.

Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.

Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.

Babacic et al., CRISPR-cas gene-editing as plausible treatment of neuromuscular and nucleotide-repeat-expansion diseases: A systematic review. PLOS One. Feb. 22, 2019;14(2):e0212198. doi: 10.1371/journal.pone.0212198.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.

Badran et al., Development of potent in vivo mutagenesis plasmids with broad mutational spectra. Nat Commun. Oct. 7, 2015;6:8425. doi: 10.1038/ncomms9425.

Bae et al., Microhomology-based choice of Cas9 nuclease target sites. Nat Methods. Jul. 2014;11(7):705-6. doi: 10.1038/nmeth.3015.

Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.

Balakrishnan et al., Flap endonuclease 1. Annu Rev Biochem. 2013;82:119-38. doi: 10.1146/annurev-biochem-072511-122603. Epub Feb. 28, 2013.

Baldari et al., A novel leader peptide which allows efficient secretion of a fragment of human interleukin 1 beta in *Saccharomyces cerevisiae*. EMBO J. Jan. 1987;6(1):229-34.

Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.

Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.

Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.

Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.

Barnes et al., Repair and genetic consequences of endogenous DNA base damage in mammalian cells. Annu Rev Genet. 2004;38:445-76.

Barnes et al., The fidelity of Taq polymerase catalyzing PCR is improved by an N-terminal deletion. Gene. Mar. 1, 1992;112(1):29-35. doi: 10.1016/0378-1119(92)90299-5.

Barrangou et al., CRISPR provides acquired resistance against viruses in prokaryotes. Science. Mar. 23, 2007;315(5819):1709-12.

Barrangou, RNA-mediated programmable DNA cleavage. Nat Biotechnol. Sep. 2012;30(9):836-8. doi: 10.1038/nbt.2357.

Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.

Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.

Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.

Basturea et al., Substrate specificity and properties of the Escherichia coli 16S rRNA methyltransferase, RsmE. RNA. Nov. 2007;13(11):1969-76. doi: 10.1261/rna.700507. Epub Sep. 13, 2007.

Batey et al., Structure of a natural guanine-responsive riboswitch complexed with the metabolite hypoxanthine. Nature. Nov. 18, 2004;432(7015):411-5.

Beale et al., Comparison of the differential context-dependence of DNA deamination by APOBEC enzymes: correlation with mutation spectra in vivo. J Mol Biol. Mar. 26, 2004;337(3):585-96.

Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.

Bedell et al., In vivo genome editing using a high-efficiency TALEN system. Nature. Nov. 1, 2012;491(7422):114-8. Doi: 10.1038/nature11537. Epub Sep. 23, 2012.

Begley, Scientists unveil the 'most clever CRISPR gadget' so far. STAT, Apr. 20, 2016. https://www.statnews.com/2016/04/20/clever-crispr-advance-unveiled/.

Behr, Gene transfer with synthetic cationic amphiphiles: prospects for gene therapy. Bioconjug Chem. Sep.-Oct. 1994;5(5):382-9. doi: 10.1021/bc00029a002.

Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.

Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.

Benarroch, HCN channels: function and clinical implications. Neurology. Jan. 15, 2013;80(3):304-10. doi: 10.1212/WNL.0b013e31827dec42.

Bennett et al., Painful and painless channelopathies. Lancet Neurol. Jun. 2014;13(6):587-99. doi: 10.1016/S1474-4422(14)70024-9. Epub May 6, 2014.

(56) References Cited

OTHER PUBLICATIONS

Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex VIVO in VIVO gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 26, 2019;10(1):1937. doi: 10.1038/s41467-019-09987-0.
Beumer et al., Efficient gene targeting in *Drosophila* with zinc-finger nucleases. Genetics. Apr. 2006;172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast Torulaspora delbrueckii. Plasmid. 1997;38(3):202-9. doi: 10.1006/plas.1997.1315.
Blau et al., A proliferation switch for genetically modified cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.

Boch, Tales of genome targeting. Nat Biotechnol. Feb. 2011;29(2):135-6. Doi: 10.1038/nbt.1767.
Bodi et al., Yeast m6A Methylated mRNAs Are Enriched on Translating Ribosomes during Meiosis, and under Rapamycin Treatment. PLOS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/117/Improved-route-single-base-genome.html.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611863100001634667.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of

(56) References Cited

OTHER PUBLICATIONS the anticodon of the pre-tRNA Leu (CAA). Nucleic Acids Res. 2006;34(20):6034-43. doi: 10.1093/nar/gk1765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Burke et al., Activating mutations of Tn3 resolvase marking interfaces important in recombination catalysis and its regulation. Mol Microbiol. Feb. 2004;51(4):937-48.
Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003;10(6):533-40. doi: 10.1016/s1074-5521(03)00109-1.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Böck et al., Selenocysteine: the 21st amino acid. Mol Microbiol. Mar. 1991;5(3):515-20.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Cargill et al., Characterization of single-nucleotide polymorphisms in coding regions of human genes. Nat Genet. Jul. 1999;22(3):231-8.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carr et al., Genome engineering. Nat Biotechnol. Dec. 2009;27(12):1151-62. doi: 10.1038/nbt.1590.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.
Chan et al., Molecular recording of mammalian embryogenesis. Nature. Jun. 2019;570(7759):77-82. doi: 10.1038/s41586-019-1184-5. Epub May 13, 2019.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chapman et al., Playing the end game: DNA double-strand break repair pathway choice. Mol Cell. Aug. 24, 2012;47(4):497-510. doi: 10.1016/j.molcel.2012.07.029.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2013.
Charpentier et al., Biotechnology: Rewriting a genome. Nature. Mar. 7, 2013;495(7439):50-1. doi: 10.1038/495050a.

(56) References Cited

OTHER PUBLICATIONS

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.
Chavez et al., Therapeutic applications of the ?C31 integrase system. Curr Gene Ther. Oct. 2011;11(5):375-81. Review.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chesnoy et al., Structure and function of lipid-DNA complexes for gene delivery. Annu Rev Biophys Biomol Struct. 2000;29:27-47.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999;181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Choi et at al., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.
Chong et al., Modulation of protein splicing of the Saccharomyces cerevisiae vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-col. purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al., Targeting G with TAL effectors: a comparison of activities of TALENs constructed with NN and NK repeat variable di-residues. PLOS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 2, 20124.

(56) References Cited

OTHER PUBLICATIONS

Chung-Il et al., Artificial control of gene expression in mammalian cells by modulating RNA interference through aptamer-small molecule interaction. RNA. May 2006;12(5):710-6. Epub Apr. 10, 2006.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011512171109 17.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting ß-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in Escherichia coli that allow rapid detection of each of the six base substitutions. Proc Natl Acad Sci U S A. Jul. 1989;86(14):5345-9.
D'ADDA di FAGAGNA et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Database EBI Accession No. ADE34233 Jan. 29, 2004.
Database EBI Accession No. BFF09785. May 31, 2018. 2 pages.
Database EBI Accession No. BGE38086. Jul. 25, 2019. 2 pages.
Database UniProt Accession No. G8I3E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.

(56) References Cited

OTHER PUBLICATIONS

Davis et al., DNA double strand break repair via non-homologous end-joining. Transl Cancer Res. Jun. 2013;2(3):130-143.

Davis et al., Small molecule-triggered Cas9 protein with improved genome-editing specificity. Nat Chem Biol. May 2015;11(5):316-8. doi: 10.1038/nchembio.1793. Epub Apr. 6, 2015.

De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.

De Souza, Primer: genome editing with engineered nucleases. Nat Methods. Jan. 2012;9(1):27.

De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.

Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.

DeKosky et al., Large-scale sequence and structural comparisons of human naive and antigen- experienced antibody repertoires. Proc Natl Acad Sci U S A. May 10, 2016;113(19):E2636-45. doi: 10.1073/pnas.1525510113. Epub Apr. 25, 2016.

Delebecque et al., Organization of intracellular reactions with rationally designed RNA assemblies. Science. Jul. 22, 2011;333(6041):470-4. doi: 10.1126/science.1206938. Epub Jun. 23, 2011.

Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.

Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.

Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.

Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.

Dianov et al., Mammalian base excision repair: the forgotten archangel. Nucleic Acids Res. Apr. 1, 2013;41(6):3483-90. doi: 10.1093/nar/gkt076. Epub Feb. 13, 2013.

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.

Dickey et al., Single-stranded DNA-binding proteins: multiple domains for multiple functions. Structure. Jul. 2, 2013;21(7):1074-84. doi: 10.1016/j.str.2013.05.013.

Dickinson et al., Experimental interrogation of the path dependence and stochasticity of protein evolution using phage-assisted continuous evolution. Proc Natl Acad Sci USA. May 2013;110(22):9007-12.

Dillon, Regulating gene expression in gene therapy. Trends Biotechnol. May 1993;11(5):167-73. doi: 10.1016/0167-7799(93)90109-M.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.

Dingwall et al., Nuclear targeting sequences—a consensus? Trends Biochem Sci. Dec. 1991;16(12):478-81. doi: 10.1016/0968-0004(91)90184-w.

Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.

Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.

Doench et al., Optimized sgRNA design to maximize activity and minimize off-target effects of CRISPR-Cas9. Nat Biotechnol. Feb. 2016;34(2):184-191. doi: 10.1038/nbt.3437.

Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.

Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.

Dominissini et al., Topology of the human and mouse m6A RNA methylomes revealed by m6A-seq. Nature. Apr. 29, 2012;485(7397):201-6. doi: 10.1038/nature11112.

Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.

Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.

Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

Doudna et al., Genome editing. The new frontier of genome engineering with CRISPR-Cas9. Science. Nov. 28, 2014;346(6213):1258096. doi: 10.1126/science.1258096.

Dove et al., Conversion of the omega subunit of *Escherichia coli* RNA polymerase into a transcriptional activator or an activation target. Genes Dev. Mar. 1, 1998;12(5):745-54.

Doyon et al., Directed evolution and substrate specificity profile of homing endonuclease I-SceI. J Am Chem Soc. Feb. 22, 2006;128(7):2477-84.

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.

Drake, A constant rate of spontaneous mutation in DNA-based microbes. Proc Natl Acad Sci U S A. Aug. 15, 1991;88(16):7160-4.

Dubois et al., Retroviral RNA Dimerization: From Structure to Functions. Front Microbiol. Mar. 22, 2018;9:527. doi: 10.3389/fmicb.2018.00527.

Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.

Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.

Dunbar et al., Gene therapy comes of age. Science. Jan. 12, 2018;359(6372):eaan4672. doi: 10.1126/science.aan4672.

Dupuy et al., Le syndrome de De La Chapelle [De La Chapelle syndrome]. Presse Med. Mar. 3, 2001;30(8):369-72. French.

Durai et al., A bacterial one-hybrid selection system for interrogating zinc finger-DNA interactions. Comb Chem High Throughput Screen. May 2006;9(4):301-11.

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

East-Seletsky et al., Two distinct RNase activities of CRISPR-C2c2 enable guide-RNA processing and RNA detection. Nature Oct. 2016;538(7624):270-3.

(56) References Cited

OTHER PUBLICATIONS

Edlund et al., Cell-specific expression of the rat insulin gene: evidence for role of two distinct 5' flanking elements. Science. Nov. 22, 1985;230(4728):912-6. doi: 10.1126/science.3904002.

Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.

Edwards et al., Crystal structures of the thi-box riboswitch bound to thiamine pyrophosphate analogs reveal adaptive RNA-small molecule recognition. Structure. Sep. 2006;14(9):1459-68.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Emery et al., HCN2 ion channels play a central role in inflammatory and neuropathic pain. Science. Sep. 9, 2011;333(6048):1462-6. doi: 10.1126/science.1206243.

Endo et al., Toward establishing an efficient and versatile gene targeting system in higher plants. Biocatalysis and Agricultural Biotechnology 2014;3,(1):2-6.

Engel et al., The emerging role of mRNA methylation in normal and pathological behavior. Genes Brain Behav. Mar. 2018;17(3):e12428. doi: 10.1111/gbb.12428. Epub Nov. 17, 2017.

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Epstein, HSV-1-based amplicon vectors: design and applications. Gene Ther. Oct. 2005;12 Suppl 1:S154-8. doi: 10.1038/sj.gt.3302617.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.

Fagerlund et al., The Cpf1 CRISPR-Cas protein expands genome-editing tools. Genome Biology Nov. 17, 2015;16:251. https://doi.org/10.1186/s13059-015-0824-9.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fang et al., Synthetic Studies Towards Halichondrins: Synthesis of the Left Halves of Norhalichondrins and Homohalichondrins. Tetrahedron Letters 1992;33(12):1557-1560.

Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.

Farhood et al., Codelivery to mammalian cells of a transcriptional factor with cis-acting element using cationic liposomes. Anal Biochem. Feb. 10, 1995;225(1):89-93.

Fawcett et al., Transposable elements controlling I-R hybrid dysgenesis in D. melanogaster are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Ferry et al., Rational design of inducible CRISPR guide RNAs for de novo assembly of transcriptional programs. Nat Commun. Mar. 3, 2017;8:14633. doi: 10.1038/ncomms14633.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Fine et al., Trans-spliced Cas9 allows cleavage of HBB and CCR5 genes in human cells using compact expression cassettes. Scientific Reports 2015;5(1):Article No. 10777. doi: 10.1038/srep10777. With Supplementary Information.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

Fischer et al., Cryptic epitopes induce high-titer humoral immune response in patients with cancer. J Immunol. Sep. 1, 2010;185(5):3095-102. doi: 10.4049/jimmunol.0902166. Epub Jul. 2, 2010.

Fitzjohn, Diversitree: comparative phylogenetic analyses of diversification in R. Methods in Evology and Evolution. Dec. 2012;3(6):1084-92 .doi: 10.1111/j.2041-210X.2012.00234.x.

Flajolet et al., Woodchuck hepatitis virus enhancer I and enhancer II are both involved in N-myc2 activation in woodchuck liver tumors. J Virol. Jul. 1998; 72(7):6175-80. doi: 10.1128/JVI.72.7.6175-6180.1998.

Flaman et al., A rapid PCR fidelity assay. Nucleic Acids Res. Aug. 11, 1994;22(15):3259-60. doi: 10.1093/nar/22.15.3259.

Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 1, 2015. Including supplementary figures and data.

Fogg et al., New applications for phage integrases. J Mol Biol. Jul. 29, 2014;426(15):2703-16. doi: 10.1016/j.jmb.2014.05.014. Epub May 22, 2014.

(56) References Cited

OTHER PUBLICATIONS

Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 2, 2013. Including Supplementary Information.
Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short- and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402- 3408.2006.
Freitas et al., Mechanisms and signals for the nuclear import of proteins. Curr Genomics. Dec. 2009;10(8):550-7. doi: 10.2174/138920209789503941.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005; 14(6):1538-44.
Fujisa Wa et al., Disease-associated mutations in CIAS1 induce cathepsin B-dependent rapid cell death of human THP-1 monocytic cells. Blood. Apr. 1, 2007;109(7):2903-11.
Fung et al., Repair at single targeted DNA double-strand breaks in pluripotent and differentiated human cells. PLOS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Fusi et al., In Silico Predictive Modeling of CRISPR/Cas9 guide efficiency. Jun. 26, 2015; bioRxiv. http://dx.doi.org/10.1101/021568.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Garibyan et al., Use of the rpoB gene to determine the specificity of base substitution mutations on the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
Genbank Submission; NIH/NCBI, Accession No. AAA66622.1. Martinelli et al., May 18, 1995. 2 pages.
Genbank Submission; NIH/NCBI, Accession No. AGT42196. Farzadfar et al., Nov. 2, 2013. 2 pages.
Genbank Submission; NIH/NCBI, Accession No. APG80656.1. Burstein et al., Dec. 10, 2016. 1 pages.
Genbank Submission; NIH/NCBI, Accession No. AYD60528.1. Ram et al., Oct. 2, 2018. 1 page.
Genbank Submission; NIH/NCBI, Accession No. BDB43378. Zhang et al., Aug. 11, 2016. 2 pages.
Genbank Submission; NIH/NCBI, Accession No. J04623. Kita et al., Apr. 26, 1993. 2 pages.
Genbank Submission; NIH/NCBI, Accession No. KR710351.1. Sahni et al., Jun. 1, 2015. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.

(56) References Cited

OTHER PUBLICATIONS

Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NM_002945.3. Weiser et al., Sep. 3, 2017. 5 pages.
Genbank Submission; NIH/NCBI, Accession No. NM_002947.4. Xiao et al., May 1, 2019. 4 pages.
Genbank Submission; NIH/NCBI, Accession No. NM_174936. Guo et al., Oct. 28, 2015. 6 pages.
Genbank Submission; NIH/NCBI, Accession No. NP_358988.1. Hoskins et al., Jan. 11, 2017. 2 pages.
Genbank Submission; NIH/NCBI, Accession No. NP_472073.1. Glaser et al., Jun. 27, 2013. 2 pages.
Genbank Submission; NIH/NCBI, Accession No. NP_628093.1. Hsiao et al., Aug. 3, 2016. 2 pages.
Genbank Submission; NIH/NCBI, Accession No. NP_955579.1. Chen et al., Aug. 13, 2018. 5 pages.
Genbank Submission; NIH/NCBI, Accession No. P42212. Prasher et al., Mar. 19, 2014. 7 pages.
Genbank Submission; NIH/NCBI, Accession No. QBJ66766. Duan et al. Aug. 12, 2020. 2 pages.
Genbank Submission; NIH/NCBI, Accession No. RFF81513.1. Zhou et al., Aug. 21, 2018. 2 pages.
Genbank Submission; NIH/NCBI, Accession No. SNX31424.1. Weckx, S., Feb. 16, 2018. 2 pages.
Genbank Submission; NIH/NCBI, Accession No. TGH57013. Xu et al., Apr. 9, 2019. 2 pages.
Genbank Submission; NIH/NCBI, Accession No. WP_016631044.1. Haft et al., Sep. 22, 2020. 1 page.
Genbank Submission; NIH/NCBI, Accession No. WP_031386437. No Author Listed., Sep. 23, 2019. 1 page.
Genbank Submission; NIH/NCBI, Accession No. WP_031589969.1. Haft et al., Oct. 9, 2019. 2 pages.
Genbank Submission; NIH/NCBI, Accession No. WP_044924278.1. Haft et al., Oct. 9, 2019. 2 pages.
Genbank Submission; NIH/NCBI, Accession No. WP_047338501.1. Haft et al., Oct. 9, 2019. 2 pages.
Genbank Submission; NIH/NCBI, Accession No. WP_060798984.1. Haft et al., Oct. 9, 2019. 2 pages.
Genbank Submission; NIH/NCBI, Accession No. WP_062913273.1. Haft et al., Oct. 9, 2019, 2 pages.
Genbank Submission; NIH/NCBI, Accession No. WP_072754838. No Author Listed., Sep. 23, 2019. 1 page.
Genbank Submission; NIH/NCBI, Accession No. WP_095142515.1. No Author Listed., Sep. 23, 2019. 1 page.
Genbank Submission; NIH/NCBI, Accession No. WP_118538418.1. No Author Listed., Oct. 13, 2019. 1 page.
Genbank Submission; NIH/NCBI, Accession No. WP_119223642.1. No Author Listed., Oct. 13, 2019. 1 page.
Genbank Submission; NIH/NCBI, Accession No. WP_119227726.1. No Author Listed., Oct. 13, 2019. 1 page.
Genbank Submission; NIH/NCBI, Accession No. WP_119623382.1. No Author Listed., Oct. 13, 2019. 1 page.
Genbank Submission; NIH/NCBI, Accession No. WP_132221894.1. No Author Listed., Sep. 23, 2019. 1 page.
Genbank Submission; NIH/NCBI, Accession No. WP_133478044.1. Haft et al., Oct. 9, 2019. 2 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_009137104.1. Davison, Aug. 13, 2018. 2 pages.
Genbank Submission; NIH/NCBI, Accession No. YP_009283008.1. Bernardini et al., Sep. 23, 2016. 2 pages.
Genbank Submission; NIH/NCBI, Accession No. YP_820832.1. Makarova et al., Aug. 27, 2013. 2 pages.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al., DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA

(56) References Cited

OTHER PUBLICATIONS

Electronic Theses and Dissertations. Jan. 1, 2019. Retrieved from the Internet via https://escholarship.org/uc/item/7vf9z54t. Last accessed on Apr. 29, 2021.

Grainge et al., The integrase family of recombinase: organization and function of the active site. Mol Microbiol. Aug. 1999;33(3):449-56.

Gregory et al., Integration site for Streptomyces phage phiBT1 and development of site-specific integrating vectors. J Bacteriol. Sep. 2003;185(17):5320-3. doi: 10.1128/jb.185.17.5320- 5323.2003.

Griffiths, Endogenous retroviruses in the human genome sequence. Genome Biol. 2001;2(6):REVIEWS1017. doi: 10.1186/GB-2001-2-6-reviews1017. Epub Jun. 5, 2001.

Grindley et al., Mechanisms of site-specific recombination. Annu Rev Biochem. 2006;75:567-605. doi: 10.1146/annurev.biochem.73.011303.073908.

Grishok et al., Genes and Mechanisms Related to RNA Interference Regulate Expression of the Small Temporal RNAs that Control C. elegans Developmental Timing. Jul. 13, 2001:106(1):P23-4.

Groher et al., Synthetic riboswitches—A tool comes of age. Biochim Biophys Acta. Oct. 2014;1839(10):964-973. doi: 10.1016/j.bbagrm.2014.05.005. Epub May 17, 2014.

Groth et al., Construction of transgenic *Drosophila* by using the site-specific integrase from phage phiC31. Genetics. Apr. 2004;166(4):1775-82. doi: 10.1534/genetics.166.4.1775.

Groth et al., Phage integrases: biology and applications. J Mol Biol. Jan. 16, 2004;335(3):667-78.

Gruber et al., Strategies for measuring evolutionary conservation of RNA secondary structures. BMC Bioinformatics. Feb. 26, 2008;9:122. doi: 10.1186/1471-2105-9-122.

Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.

Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.

Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.

Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.

Guo et al., Facile functionalization of FK506 for biological studies by the thiol-ene 'click' reaction. RSC Advances. 2014;22:11400-3.

Guo et al., Structure of Cre recombinase complexed with DNA in a site-specific recombination synapse. Nature. Sep. 4, 1997;389(6646):40-6.

Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.

Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.

Guzman et al., Tight regulation, modulation, and high-level expression by vectors containing the arabinose PBAD promoter. J Bacteriol. 1995;177(14):4121-4130.

Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.

Haddada et al., Gene therapy using adenovirus vectors. Curr Top Microbiol Immunol. 1995;199 ( Pt 3):297-306. doi: 10.1007/978-3-642-79586-2_14.

Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.

Hale et al., RNA-guided RNA cleavage by a CRISPR RNA-Cas protein complex. Cell. Nov. 25, 2009;139(5):945-56. doi: 10.1016/j.cell.2009.07.040.

Halmai er al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confeX.com/aiche/epibiol8/webprogram/paper544785.html. Retrieved Jun. 29, 2020.

Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.

Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.

Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.

Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-basedtech-edits-single-nucleotides-without-breaking-dna.

Handa et al., Template-assisted synthesis of adenine-mutagenized cDNA by a retroelement protein complex. Nucleic Acids Res. Oct. 12, 2018;46(18):9711-9725. doi: 10.1093/nar/gky620.

Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.

Harms et al., Evolutionary biochemistry: revealing the historical and physical causes of protein properties. Nat Rev Genet. Aug. 2013;14(8):559-71. doi: 10.1038/nrg3540.

Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.

Harris et al., RNA Editing Enzyme APOBEC1 and Some of Its Homologs Can Act as DNA Mutators. Mol Cell. Nov. 2002;10(5):1247-53.

Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

Hartung et al., Cre mutants with altered DNA binding properties. J Biol Chem. Sep. 4, 1998;273(36):22884-91.

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.

Hasegawa et al., Spontaneous mutagenesis associated with nucleotide excision repair in *Escherichia coli*. Genes Cells. May 2008;13(5):459-69. doi: 10.1111/j.1365-2443.2008.01185.x.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Hector et al., CDKL5 variants: Improving our understanding of a rare neurologic disorder. Neurol Genet. Dec. 15, 2017;3(6):e200. doi: 10.1212/NXG.0000000000000200.

Heidenreich et al., Non-homologous end joining as an important mutagenic process in cell cycle-arrested cells. Embo J. May 1, 2003;22(9):2274-83. doi: 10.1093/emboj/cdg203.

Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.

Heller et al., Replisome assembly and the direct restart of stalled replication forks. Nat Rev Mol Cell Biol. Dec. 2006;7(12):932-43. Epub Nov. 8, 2006.

(56) References Cited

OTHER PUBLICATIONS

Hendricks et al., The S. cerevisiae Mag1 3-methyladenine DNA glycosylase modulates susceptibility to homologous recombination. DNA Repair (Amst). 2002;1(8):645-659.

Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.

Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.

Hickford et al., Antitumour polyether macrolides: four new halichondrins from the New Zealand deep-water marine sponge Lissodendoryx sp. Bioorg Med Chem. Mar. 15, 2009;17(6):2199-203. doi: 10.1016/j.bmc.2008.10.093. Epub Nov. 19, 2008.

Hida et al., Directed evolution for drug and nucleic acid; delivery. Adv Drug Deliv Rev. Dec. 22, 2007;59(15):1562-78. Epub Aug. 28, 2007.; Review.

Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

Hille et al., The Biology of CRISPR-Cas: Backward and Forward. Cell. Mar. 8, 2018;172(6):1239-1259. doi: 10.1016/j.cell.2017.11.032.

Hilton et al., Enabling functional genomics with genome engineering. Genome Res. Oct. 2015;25(10):1442-55. doi: 10.1101/gr.190124.115.

Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.

Hirano et al., Structural Basis for the Altered PAM Specificities of Engineered CRISPR-Cas9. Mol Cell. Mar. 17, 2016;61(6):886-94. doi: 10.1016/j.molcel.2016.02.018.

Hoang et al., UFBoot2: Improving the Ultrafast Bootstrap Approximation. Mol Biol Evol. Feb. 1, 2018;35(2):518-522. doi: 10.1093/molbev/msx281.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Hoernes et al., Translating the epitranscriptome. Wiley Interdiscip Rev RNA. Jan. 2017;8(1):e1375. doi: 10.1002/wrna.1375. Epub Jun. 27, 2016.

Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hollis et al., Phage integrases for the construction and manipulation of transgenic mammals. Reprod Biol Endocrinol. Nov. 7, 2003;1:79. doi: 10.1186/1477-7827-1-79.

Holsinger et al., Signal transduction in T lymphocytes using a conditional allele of Sos. Proc Natl Acad Sci U S A. Oct. 1, 19950;92(21):9810-4. doi: 10.1073/pnas.92.21.9810.

Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.

Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.

Hoogenboom et al., Natural and designer binding sites made by phage display technology. Immunol Today. Aug. 2000;21(8):371-8.

Horvath et al., CRISPR/Cas, the immune system of bacteria and archaea. Science. Jan. 8, 2010;327(5962):167-70. doi: 10.1126/science.1179555.

Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.

Hotta et al., [Neurotropic viruses—classification, structure and characteristics]. Nihon Rinsho. Apr. 1997;55(4):777-82. Japanese.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Howard et al., Intracerebral drug delivery in rats with lesion-induced memory deficits. J Neurosurg. Jul. 1989;71(1):105-12.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Hu et al., Evolved Cas9 variants with broad PAM compatibility and high DNA specificity. Nature. Apr. 5, 2018;556(7699):57-63. doi: 10.1038/nature26155. Epub Feb. 28, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huang et al., Heritable gene targeting in zebrafish using customized TALENs. Nat Biotechnol. Aug. 5, 2011;29(8):699-700. doi: 10.1038/nbt.1939.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Humbert et al., Targeted gene therapies: tools, applications, optimization. Crit Rev Biochem Mol Biol. May-Jun. 2012;47(3):264-81. doi: 10.3109/10409238.2012.658112.

Hung et al., Protein localization in disease and therapy. J Cell Sci. Oct. 15, 2011;124(Pt 20):3381-92. doi: 10.1242/jcs.089110.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Husimi, Selection and evolution of bacteriophages in cellstat. Adv Biophys. ; 1989;25:1-43. Review.

Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

(56) References Cited

OTHER PUBLICATIONS

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T—: a new member of the Din family of site-specific recombinases. Mol Microbiol. Jun. 1990;4(6):991-7. doi: 10.1111/j.1365-2958.1990.tb00671.x.

Ikediobi et al., Mutation analysis of 24 known cancer genes in the NCI-60 cell line set. Mol Cancer Ther. Nov. 2006;5(11):2606-12. Epub Nov. 6, 2006.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jansen et al., Identification of genes that are associated with DNA repeats in prokaryotes. Mol Microbiol. Mar. 2002;43(6):1565-75.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jeggo, DNA breakage and repair. Adv Genet. 1998;38:185-218. doi: 10.1016/s0065-2660(08)60144-3.

Jemielity et al., Novel "anti-reverse" cap analogs with superior translational properties. RNA. Sep. 2003;9(9):1108-22. doi: 10.1261/rna.5430403.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jiang et al., Chemical modifications of adenine base editor mRNA and guide RNA expand its application scope. Nat Commun. Apr. 24, 2020;11(1):1979. doi: 10.1038/s41467-020-15892-8.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jiang et al., Structural Biology. A Cas9-guide RNA Complex Preorganized for Target DNA Recognition. Science. Jun. 26, 2015;348(6242):1477-81. doi: 10.1126/science.aab1452.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jiricny, The multifaceted mismatch-repair system. Nat Rev Mol Cell Biol. May 2006;7(5):335-46. doi: 10.1038/nrm1907.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Johns et al., The promise and peril of continuous in vitro evolution. J Mol Evol. Aug. 2005;61(2):253-63. Epub Jun. 27, 2005.

Joho et al., Identification of a region of the bacteriophage T3 and T7 Rna polymerases that determines promoter specificity. J Mol Biol. Sep. 5, 1990;215(1):31-9.

Joung et al., TALENs: a widely applicable technology for targeted genome editing. Nat Rev Mol Cell Biol. Jan. 2013;14(1):49-55. doi: 10.1038/nrm3486. Epub Nov. 21, 2012.

Joyce et al., Amplification, mutation and selection of catalytic RNA. Gene. Oct. 15, 1989;82(1):83-7. doi: 10.1016/0378-1119(89)90033-4.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.

Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.

Kahmann et al., G inversion in bacteriophage Mu DNA is stimulated by a site within the invertase gene and a host factor. Cell. Jul. 1985;41(3):771-80. doi: 10.1016/s0092-8674(85)80058-1.

Kaiser et al., Gene therapy. Putting the fingers on gene repair. Science. Dec. 23, 2005;310(5756):1894-6.

Kakiyama et al., A peptide release system using a photo-cleavable linker in a cell array format for cell-toxicity analysis. Polymer J. Feb. 27, 2013;45:535-9.

Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.

(56) References Cited

OTHER PUBLICATIONS

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Karimova et al., Discovery of Nigri/nox and Panto/pox site-specific recombinase systems facilitates advanced genome engineering. Sci Rep. Jul. 22, 2016;6:30130. doi: 10.1038/srep30130.

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.

Kaufman et al., Translational efficiency of polycistronic mRNAs and their utilization to express heterologous genes in mammalian cells. EMBO J. Jan. 1987;6(1):187-93.

Kavli et al., Excision of cytosine and thymine from DNA by mutants of human uracil-DNA glycosylase. EMBO J. Jul. 1, 1996;15(13):3442-7.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Kay et al., Viral vectors for gene therapy: the art of turning infectious agents into vehicles of therapeutics. Nat Med. Jan. 2001;7(1):33-40.

Keijzers et al., Human exonuclease 1 (EXO1) activity characterization and its function on flap structures. Biosci Rep. Apr. 25, 2015;35(3):e00206. doi: 10.1042/BSR20150058.

Kellendonk et al., Regulation of Cre recombinase activity by the synthetic steroid RU 486. Nucleic Acids Res. Apr. 1, 19965;24(8):1404-11.

Kelman, PCNA: structure, functions and interactions. Oncogene. Feb. 13, 1997;14(6):629-40. doi: 10.1038/sj.onc.1200886.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.

Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.

Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.

Kilbride et al., Determinants of product topology in a hybrid Cre-Tn3 resolvase site-specific recombination system. J Mol Biol. Jan. 13, 2006;355(2):185-95. Epub Nov. 9, 2005.

Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.

Kim et al., DJ-1, a novel regulator of the tumor suppressor PTEN. Cancer Cell. 2005;7(3):263-273.

Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.

Kim et al., A library of TAL effector nucleases spanning the human genome. Nat Biotechnol. Mar. 2013;31(3):251-8. Doi: 10.1038/nbt.2517. Epub Feb. 17, 2013.

Kim et al., An anionic human protein mediates cationic liposome delivery of genome editing proteins into mammalian cells. Nat Commun. Jul. 2, 2019;10(1):2905. doi: 10.1038/s41467-019-10828-3.

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.

Kim et al., Genome-wide target specificities of CRISPR RNA-guided programmable deaminases. Nat Biotechnol. May 2017;35(5):475-480. doi: 10.1038/nbt.3852. Epub Apr. 10, 2017.

Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.

Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.

Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.

Kim et al., In vivo high-throughput profiling of CRISPR-Cpf1 activity. Nat Methods. Feb. 2017;14(2):153-159. doi: 10.1038/nmeth.4104. Epub Dec. 19, 2016.

Kim et al., Mycobacteriophage Bxb1 integrates into the Mycobacterium smegmatis groEL1 gene. Mol Microbiol. Oct. 2003;50(2):463-73. doi: 10.1046/j.1365-2958.2003.03723.x.

Kim et al., Rescue of high-specificity Cas9 variants using sgRNAs with matched 5' nucleotides. Genome Biol. Nov. 15, 2017;18(1):218. doi: 10.1186/s13059-017-1355-3.

Kim et al., TALENs and ZFNs are associated with different mutationsignatures. Nat Methods. Mar. 2013;10(3):185. doi: 10.1038/nmeth.2364. Epub Feb. 10, 2013.

Kim et al., Targeted genome editing in human cells with zinc finger nucleases constructed via modular assembly. Genome Res. Jul. 2009;19(7):1279-88. doi: 10.1101/gr.089417.108. Epub May 21, 2009.

Kim et al., The role of apolipoprotein E in Alzheimer's disease. Neuron. Aug. 13, 2009;63(3):287-303. doi: 10.1016/j.neuron.2009.06.026.

Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.

(56) References Cited

OTHER PUBLICATIONS

Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with No. detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Structural and functional consequences of the mutation of a conserved arginine residue in alphaA and alphaB crystallins. J Biol Chem. Aug. 20, 1999;274(34):24137-41.
Kunkel et al., Eukaryotic Mismatch Repair in Relation to DNA Replication. Annu Rev Genet. 2015;49:291-313. doi: 10.1146/annurev-genet-112414-054722.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kuscu et al., CRISPR-Cas9-AID base editor is a powerful gain-of-function screening tool. Nat Methods. Nov. 29, 2016;13(12):983-984. doi: 10.1038/nmeth.4076.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Kwon et al., Chemical basis of glycine riboswitch cooperativity. RNA. Jan. 2008;14(1):25-34. Epub Nov. 2, 2007.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Lada et al., Mutator effects and mutation signatures of editing deaminases produced in bacteria and yeast. Biochemistry (Mosc). Jan. 2011;76(1):131-46.

(56) References Cited

OTHER PUBLICATIONS

Lakich et al., Inversions disrupting the factor VIII gene are a common cause of severe haemophilia A. Nat Genet. Nov. 1993;5(3):236-41. doi: 10.1038/ng1193-236.

Lancaster et al., Limited trafficking of a neurotropic virus through inefficient retrograde axonal transport and the type I interferon response. PLOS Pathog. Mar. 5, 2010;6(3):e1000791. doi: 10.1371/journal.ppat.1000791.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.

Lapinaite et al., DNA capture by a CRISPR-Cas9-guided adenine base editor. Science. Jul. 31, 2020;369(6503):566-571. doi: 10.1126/science.abb1390.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.

Lazarevic et al., Nucleotide sequence of the Bacillus subtilis temperate bacteriophage SPbetac2. Microbiology (Reading). May 1999;145 (Pt 5):1055-1067. doi: 10.1099/13500872-145-5-1055.

Le Grice et al., Purification and characterization of recombinant equine infectious anemia virus reverse transcriptase. J Virol. Dec. 1991;65(12):7004-7. doi: 10.1128/JVI.65.12.7004-7007.1991.

Leaver-Fay et al., ROSETTA3: an object-oriented software suite for the simulation and design of macromolecules. Methods Enzymol. 2011;487:545-74. doi: 10.1016/B978-0-12-381270-4.00019-6.

Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., Recognition of liposomes by cells: in vitro binding and endocytosis mediated by specific lipid headgroups and surface charge density. Biochim Biophys Acta. Jan. 31, 1992;1103(2):185-97.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Lee et al., Simultaneous targeting of linked loci in mouse embryos using base editing. Sci Rep. Feb. 7, 2019;9(1):1662. doi: 10.1038/s41598-018-33533-5.

Lee et al., Site-specific integration of mycobacteriophage L5: integration-proficient vectors for *Mycobacterium smegmatis, Mycobacterium tuberculosis,* and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lee et al., Transcriptional regulation and its misregulation in disease. Cell. Mar. 14, 2013;152(6):1237-51. doi: 10.1016/j.cell.2013.02.014.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.

Levy et al., Cytosine and adenine base editing of the brain, liver, retina, heart and skeletal muscle of mice via adeno-associated viruses. Nat Biomed Eng. 2020;4(1):97-110. doi: 10.1038/s41551-019-0501-5.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Codon 129 polymorphism of the human prion protein influences the kinetics of amyloid formation. J Gen Virol. Aug. 2006;87(Pt 8):2443-9.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

(56) References Cited

OTHER PUBLICATIONS

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Loss of post-translational modification sites in disease. Pac Symp Biocomput. 2010:337-47. doi: 10.1142/9789814295291_0036.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Li, Mechanisms and functions of DNA mismatch repair. Cell Res. Jan. 2008;18(1):85-98. doi: 10.1038/cr.2007.115.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lienert et al., Two- and three-input TALE-based and logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.
Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLOS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. 2006;118(1):96-100.
Liu et al., Flap endonuclease 1: a central component of DNA metabolism. Annu Rev Biochem. 2004;73:589-615. doi:10.1146/annurev.biochem.73.012803.092453.
Liu et al., Functional Nucleic Acid Sensors. Chem Rev. May 2009;109(5):1948-98. doi: 10.1021/cr030183i.
Liu et al., Genetic incorporation of unnatural amino acids into proteins in mammalian cells. Nat Methods. Mar. 2007;4(3):239-44. Epub Feb. 25, 2007.
Liu et al., Highly efficient RNA-guided base editing in rabbit. Nat Commun. Jul. 13, 2018;9(1):2717. doi: 10.1038/s41467-018-05232-2.
Liu et al., N(6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., Reverse transcriptase of foamy virus. Purification of the enzymes and immunological identification. Arch Virol. 1977;55(3):187-200. doi: 10.1007/BF01319905.
Liu et al., Reverse transcriptase-mediated tropism switching in Bordetella bacteriophage. Science. Mar. 15, 2002;295(5562):2091-4. doi: 10.1126/science.1067467.

(56) References Cited

OTHER PUBLICATIONS

Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.
Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.
Lorenz et al., ViennaRNA Package 2.0. Algorithms Mol Biol. Nov. 24, 2011;6:26. doi: 10.1186/1748-7188-6-26.
Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.
Luckow et al., High level expression of nonfused foreign genes with Autographa californica nuclear polyhedrosis virus expression vectors. Virology. May 1989;170(1):31-9. doi: 10.1016/0042-6822(89)90348-6.
Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Lynch, Evolution of the mutation rate. Trends Genet. Aug. 2010;26(8):345-52. doi: 10.1016/j.tig.2010.05.003. Epub Jun. 30, 2010.
Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.
Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.
Ma et al., In vitro protein engineering using synthetic tRNA(Ala) with different anticodons. Biochemistry. Aug. 10, 1993;32(31):7939-45.
Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? Crispr J. Oct. 2018; 1(5):325-336. doi: 10.1089/crispr.2018.0033.
Makarova et al., Evolution and classification of the CRISPR-Cas systems. Nat Rev Microbiol. Jun. 2011;9(6):467-77. doi: 10.1038/nrmicro2577. Epub May 9, 2011.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Makeyev et al., Evolutionary potential of an RNA virus. J Virol. Feb. 2004;78(4):2114-20.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marquart et al., Predicting base editing outcomes with an attention-based deep learning algorithm trained on high-throughput target library screeen. bioRxiv. Jul. 5, 2020. DOI:10.1101/2020.07.05.

(56) References Cited

OTHER PUBLICATIONS

186544. Retrieved from the Internet via https://www.biorxiv.org/content/10.1101/2020.07.05.186544v1.full.pdf lased accessed on Apr. 28, 2021.
Marraffini et al., CRISPR interference limits horizontal gene transfer in staphylococci by targeting DNA. Science. Dec. 19, 2008;322(5909):1843-5. doi: 10.1126/science.1165771.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Marzec et al., Prime Editing: A New Way for Genome Editing. Trends Cell Biol. Apr. 2020;30(4):257-259. doi: 10.1016/j.tcb.2020.01.004. Epub Jan. 27, 2020.
Mascola et al., HIV-1 neutralizing antibodies: understanding nature's pathways. Immunol Rev. Jul. 2013;254(1):225-44. doi: 10.1111/imr.12075.
Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.
Matsuura et al., A gene essential for the site-specific excision of actinophage r4 prophage genome from the chromosome of a lysogen. J Gen Appl Microbiol. 1995;41(1):53-61.
May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.
McCarroll et al., Copy-number variation and association studies of human disease. Nat Genet. Jul. 2007;39(7 Suppl):S37-42. doi: 10.1038/ng2080.
McDonald et al., Characterization of mutations at the mouse phenylalanine hydroxylase locus. Genomics. Feb. 1, 1997;39(3):402-5. doi: 10.1006/geno.1996.4508.
McInerney et al., Error Rate Comparison during Polymerase Chain Reaction by DNA Polymerase. Mol Biol Int. 2014;2014:287430. doi: 10.1155/2014/287430. Epub Aug. 17, 2014.
McKenna et al., Recording development with single cell dynamic lineage tracing. Development. Jun. 27, 2019;146(12):dev169730. doi: 10.1242/dev.169730.
McKenna et al., Whole-organism lineage tracing by combinatorial and cumulative genome editing. Science. Jul. 29, 2016;353(6298):aaf7907. doi: 10.1126/science.aaf7907. Epub May 26, 2016.
McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.
McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.
Mead et al., A novel protective prion protein variant that colocalizes with kuru exposure. N Engl J Med. Nov. 19, 2009;361(21):2056-65. doi: 10.1056/NEJMoa0809716.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.
Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Mertens et al., Site-specific recombination in bacteriophage Mu: characterization of binding sites for the DNA invertase Gin. Embo J. Apr. 1988;7(4):1219-27.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.
Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.
Meyer et al., Library generation by gene shuffling. Curr Protoc Mol Biol. Jan. 6, 2014;105:Unit 15.12.. doi: 10.1002/0471142727.mb1512s105.
Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.
Michel et al., Mitochondrial class II introns encode proteins related to the reverse transcriptases of retroviruses. Nature. Aug. 15-21, 1985;316(6029):641-3. doi: 10.1038/316641a0.
Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.
Mihai et al., PTEN inhibition improves wound healing in lung epithelia through changes in cellular mechanics that enhance migration. Am J Physiol Lung Cell Mol Physiol. 2012;302(3):L287-L299.
Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.
Miller et al., A TALE nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Miller et al., Construction and properties of retrovirus packaging cells based on gibbon ape leukemia virus. J Virol. May 1991;65(5):2220-4. doi: 10.1128/JVI.65.5.2220-2224.1991.
Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.
Miller, Human gene therapy comes of age. Nature. Jun. 11, 1992;357(6378):455-60. doi: 10.1038/357455a0.
Mills et al., Protein splicing in trans by purified N- and C-terminal fragments of the Mycobacterium tuberculosis RecA intein. Proc Natl Acad Sci U S A. Mar. 31, 1998;95(7):3543-8. doi: 10.1073/pnas.95.7.3543.
Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mir et al., Two Active Site Divalent Ions in the Crystal Structure of the Hammerhead Ribozyme Bound to a Transition State Analogue. Biochemistry . . . Feb. 2, 2016;55(4):633-6. doi: 10.1021/acs.biochem.5b01139. Epub Jan. 19, 2016.
Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

(56) References Cited

OTHER PUBLICATIONS

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitani et al., Delivering therapeutic genes—matching approach and application. Trends Biotechnol. May 1993;11(5):162-6. doi: 10.1016/0167-7799(93)90108-L.

Mitton-Fry et al., Poly(A) tail recognition by a viral RNA element through assembly of a triple helix. Science. Nov. 26, 2010;330(6008):1244-7. doi: 10.1126/science.1195858.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.

Mohr et al., Thermostable group II intron reverse transcriptase fusion proteins and their use in CDNA synthesis and next-generation RNA sequencing. RNA. Jul. 2013;19(7):958-70. doi: 10.1261/rna.039743.113. Epub May 22, 2013.

Mojica et al., Intervening sequences of regularly spaced prokaryotic repeats derive from foreign genetic elements. J Mol Evol. Feb. 2005;60(2):174-82.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.

Mol et al., Crystal structure of human uracil-DNA glycosylase in complex with a protein inhibitor: protein mimicry of DNA. Cell. Sep. 8, 1995;82(5):701-8.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Monahan et al., Site-specific incorporation of unnatural amino acids into receptors expressed in Mammalian cells. Chem Biol. Jun. 2003;10(6):573-80.

Monot et al., The specificity and flexibility of l1 reverse transcription priming at imperfect T-tracts. PLOS Genet. May 2013;9(5):e1003499. doi: 10.1371/journal.pgen.1003499. Epub May 9, 2013.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.

Morita et al., The site-specific recombination system of actinophage TG1. FEMS Microbiol Lett. Aug. 2009;297(2):234-40. doi: 10.1111/j.1574-6968.2009.01683.x.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mougiakos et al., Characterizing a thermostable Cas9 for bacterial genome editing and silencing. Nat Commun. Nov. 21, 2017;8(1):1647. doi: 10.1038/s41467-017-01591-4.

Muir et al., Expressed protein ligation: a general method for protein engineering. Proc Natl Acad Sci U S A. Jun. 9, 1998;95(12):6705-10. doi: 10.1073/pnas.95.12.6705.

Mumtsidu et al., Structural features of the single-stranded DNA-binding protein of Epstein- Barr virus. J Struct Biol. Feb. 2008;161(2):172-87. doi: 10.1016/j.jsb.2007.10.014. Epub Nov. 1, 2007.

Murphy, Phage recombinases and their applications. Adv Virus Res. 2012;83:367-414. doi: 10.1016/B978-0-12-394438-2.00008-6. Review.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Muzyczka et al., Adeno-associated virus (AAV) vectors: will they work? J Clin Invest. Oct. 1994;94(4):1351. doi: 10.1172/JCI117468.

Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.

Myers et al., Insulin signal transduction and the IRS proteins. Annu Rev Pharmacol Toxicol. 1996;36:615-58. doi: 10.1146/annurev.pa.36.040196.003151.

Nabel et al., Direct gene transfer for immunotherapy and immunization. Trends Biotechnol. May 1993;11(5):211-5. doi: 10.1016/0167-7799(93)90117-R.

Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.

Nahvi et al., Coenzyme B12 riboswitches are widespread genetic control elements in prokaryotes. Nucleic Acids Res. Jan. 2, 2004;32(1):143-50.

Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.

Nakamura et al., Codon usage tabulated from international DNA sequence databases: status for the year 2000. Nucleic Acids Res. Jan. 1, 2000;28(1):292. doi: 10.1093/nar/28.1.292.

Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.

(56) References Cited

OTHER PUBLICATIONS

Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of Staphylococcus aureus Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
O'Maille et al., Structure-based combinatorial protein engineering (SCOPE). J Mol Biol. Aug. 23, 2002;321(4):677-91.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Oakes et al., Protein engineering of Cas9 for enhanced function. Methods Enzymol. 2014;546:491-511.

Odsbu et al., Specific N-terminal interactions of the Escherichia coli SeqA protein are required to form multimers that restrain negative supercoils and form foci. Genes Cells. Nov. 2005; 10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Offord, Advances in Genome Editing. The Scientist, Apr. 20, 2016. http://www.the-scientist.com/?articles.view/articleNo/45903/title/Advances-in-Genome-Editing/.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Osborn et al., TALEN-based gene correction for epidermolysis bullosa. Mol Ther. Jun. 2013;21(6):1151-9. doi: 10.1038/mt.2013.56. Epub Apr. 2, 2013.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi:10.1126/science.1207339.
Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Pan et al., Biological and biomedical applications of engineered nucleases. Mol Biotechnol. Sep. 2013;55(1):54-62. doi: 10.1007/s12033-012-9613-9.

(56) References Cited

OTHER PUBLICATIONS

Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with No. risk of genomic integration, delivers CRISPR/Cas9 for efficient gene editing. Mol Ther Methods Clin Dev. Aug. 24, 2016;3:16057. doi: 10.1038/mtm.2016.57.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Patel et al., Flap endonucleases pass 5'-flaps through a flexible arch using a disorder-thread- order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.

Perler, Protein splicing of inteins and hedgehog autoproteolysis: structure, function, and evolution. Cell. Jan. 9, 1998;92(1):1-4. doi: 10.1016/s0092-8674(00)80892-2.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841- 8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLOS One. Apr. 29, 2011;6(4):e19537. doi: 10.1371/journal.pone.0019537.
Pruschy et al., Mechanistic studies of a signaling pathway activated by the organic dimerizer FK1012. Chem Biol. Nov. 1994;1(3):163-72. doi: 10.1016/1074-5521(94)90006-x.
Prykhozhij et al., CRISPR multitargeter: a web tool to find common and unique CRISPR single guide RNA targets in a set of similar sequences. PLOS One. Mar. 5, 2015;10(3):e0119372. doi: 10.1371/journal.pone.0119372. eCollection 2015.

(56) References Cited

OTHER PUBLICATIONS

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Rakonjac et al., Roles of PIII in filamentous phage assembly. J Mol Biol. 1998; 282(1)25-41.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramamurthy et al., Identification of immunogenic B-cell epitope peptides of rubella virus E1 glycoprotein towards development of highly specific immunoassays and/or vaccine. Conference Abstract. 2019.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using Staphylococcus aureus Cas9. Nature. Apr. 9, 2015;520(7546):186-91. doi: 10.1038/nature14299. Epub Apr. 1, 2015.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rath et al., Fidelity of end joining in mammalian episomes and the impact of Metnase on joint processing. BMC Mol Biol. Mar. 22, 2014;15:6. doi: 10.1186/1471-2199-15-6.
Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ravishankar et al., X-ray analysis of a complex of Escherichia coli uracil DNA glycosylase (EcUDG) with a proteinaceous inhibitor. The structure elucidation of a prokaryotic UDG. Nuclei Acids Res. 26 (21): 4880-4887 (1998).
Ray et al., A compendium of RNA-binding motifs for decoding gene regulation. Nature. Jul. 11, 2013;499(7457):172-7. doi: 10.1038/nature12311.
Ray et al., Homologous recombination: ends as the means. Trends Plant Sci. Oct. 2002;7(10):435-40.
Rebar et al., Phage display methods for selecting zinc finger proteins with novel DNA-binding specificities. Methods Enzymol. 1996;267:129-49.
Rebuzzini et al., New mammalian cellular systems to study mutations introduced at the break site by non-homologous end-joining. DNA Repair (Amst). May 2, 2005;4(5):546-55.
Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Relph et al., Recent developments and current status of gene therapy using viral vectors in the United Kingdom. BMJ. 2004;329(7470):839-842. doi:10.1136/bmj.329.7470.839.
Remy et al., Gene transfer with a series of lipophilic DNA-binding molecules. Bioconjug Chem. Nov. Dec. 1994;5(6):647-54. doi: 10.1021/bc00030a021.
Ren et al., In-line Alignment and $Mg^{2}$? Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., FLASH assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Riechmann et al., The C-terminal domain of TolA is the coreceptor for filamentous phage infection of *E. coli*. Cell. 1997; 90(2):351-60. PMID:9244308.
Ringrose et al., The Kw recombinase, an integrase from Kluyveromyces waltii. Eur J Biochem. Sep. 15, 1997;248(3):903-12. doi: 10.1111/j.1432-1033.1997.00903.x.

(56) References Cited

OTHER PUBLICATIONS

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robertson et al., DNA repair in mammalian cells: Base excision repair: the long and short of it. Cell Mol Life Sci. Mar. 2009;66(6):981-93. doi: 10.1007/s00018-009-8736-z.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Rüfer et al., Non-contact positions impose site selectivity on Cre recombinase. Nucleic Acids Res. Jul. 1, 2002;30(13):2764-71. doi: 10.1093/nar/gkf399.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of *Saccharomyces cerevisiae*. Prog Nucleic Acid Res Mol Biol. 1995;51:53-91.
Sage et al., Proliferation of functional hair cells in vivo in the absence of the retinoblastoma protein. Science. Feb. 1, 20058;307(5712):1114-8. Epub Jan. 13, 2005.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.

(56) References Cited

OTHER PUBLICATIONS

Savic et al., Covalent linkage of the DNA repair template to the CRISPR-Cas9 nuclease enhances homology-directed repair. Elife. May 29, 2018;7:e33761. doi: 10.7554/eLife.33761.

Saville et al., A site-specific self-cleavage reaction performed by a novel RNA in Neurospora mitochondria. Cell. May 18, 1990;61(4):685-96. doi: 10.1016/0092-8674(90)90480-3.

Savva et al., The structural basis of specific base-excision repair by uracil-DNA glycosylase. Nature. Feb. 9, 1995;373(6514):487-93. doi: 10.1038/373487a0.

Schaaper et al., Base selection, proofreading, and mismatch repair during DNA replication in *Escherichia coli*. J Biol Chem. Nov. 15, 1993;268(32):23762-5.

Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

Schaefer et al., Understanding RNA modifications: the promises and technological bottlenecks of the 'epitranscriptome'. Open Biol. May 2017;7(5):170077. doi: 10.1098/rsob.170077.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001;108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schriefer et al., Low pressure DNA shearing: a method for random DNA sequence analysis. Nucleic Acids Res. Dec. 25, 1990;18(24):7455-6.

Schultz et al., Expression and secretion in yeast of a 400-kDa envelope glycoprotein derived from Epstein-Barr virus. Gene. 1987;54(1):113-23. doi: 10.1016/0378-1119(87)90353-2.

Schultz et al., Oligo-2'-fluoro-2'-deoxynucleotide N3'—>P5' phosphoramidates: synthesis and properties. Nucleic Acids Res. Aug. 1, 1996;24(15):2966-73.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Schwartz et al., Post-translational enzyme activation in an animal via optimized conditional protein splicing. Nat Chem Biol. Jan. 2007;3(1):50-4. Epub Nov. 26, 2006.

Schwarze et al., In vivo protein transduction: delivery of a biologically active protein into the mouse. Science. Sep. 3, 1999;285(5433):1569-72.

Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.

Sclimenti et al., Directed evolution of a recombinase for improved genomic integration at a native human sequence. Nucleic Acids Res. Dec. 15, 2001;29(24):5044-51.

Scott et al., Production of cyclic peptides and proteins in vivo. Proc Natl Acad Sci U S A. Nov. 23, 1999;96(24):13638-43. doi: 10.1073/pnas.96.24.13638.

Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.

Seed, An LFA-3 cDNA encodes a phospholipid-linked membrane protein homologous to its receptor CD2. Nature. Oct. 29-Nov. 4, 1987;329(6142):840-2. doi: 10.1038/329840a0.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Sells et al., Delivery of protein into cells using polycationic liposomes. Biotechniques. Jul. 1995;19(1):72-6, 78.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Semple et al., Rational design of cationic lipids for siRNA delivery. Nat Biotechnol. Feb. 2010;28(2):172-6. doi: 10.1038/nbt.1602. Epub Jan. 17, 2010.

Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

Serganov et al., Structural basis for discriminative regulation of gene expression by adenine- and guanine-sensing mRNAs. Chem Biol. Dec. 2004;11(12):1729-41.

Serganov et al., Structural basis for gene regulation by a thiamine pyrophosphate-sensing riboswitch. Nature. Jun. 29, 2006;441(7097):1167-71. Epub May 21, 2006.

Seripa et al., The missing ApoE allele. Ann Hum Genet. Jul. 2007;71(Pt 4):496-500. Epub Jan. 22, 2007.

Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.

Setten et al., The current state and future directions of RNAi-based therapeutics. Nat Rev Drug Discov. Jun. 2019;18(6):421-446. doi: 10.1038/s41573-019-0017-4.

Severinov et al., Expressed protein ligation, a novel method for studying protein-protein interactions in transcription. J Biol Chem. Jun. 26, 1998;273(26):16205-9. doi: 10.1074/jbc.273.26.16205.

Sha et al., Monobodies and other synthetic binding proteins for expanding protein science. Protein Sci. May 2017;26(5):910-924. doi: 10.1002/pro.3148. Epub Mar. 24, 2017.

Shah et al., Inteins: nature's gift to protein chemists. Chem Sci. 2014;5(1):446-461.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shah et al., Protospacer recognition motifs: mixed identities and functional diversity. RNA Biol. May 2013;10(5):891-9. doi: 10.4161/rna.23764. Epub Feb. 12, 2013.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Shaikh et al., Chimeras of the Flp and Cre recombinases: tests of the mode of cleavage by Flp and Cre. J Mol Biol. Sep. 8, 2000;302(1):27-48.

Shalem et al., High-throughput functional genomics using CRISPR-Cas9. Nat Rev Genet. May 2015;16(5):299-311. doi: 10.1038/nrg3899. Epub Apr. 9, 2015.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.

Sharma et al., Efficient introduction of aryl bromide functionality into proteins in vivo. FEBS Lett. Feb. 4, 2000;467(1):37-40.

Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.

(56) References Cited

OTHER PUBLICATIONS

Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the Mycobacterium tuberculosis RecA intein: design of a minimal intein and of a trans-splicing system involving two intein fragments. Gene. Jan. 30, 1998;207(2):187-95. doi: 10.1016/s0378-1119(97)00624-0.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Simonelli et al., Base excision repair intermediates are mutagenic in mammalian cells. Nucleic Acids Res. Aug. 2, 2005;33(14):4404-11. Print 2005.
Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sjoblom et al., The consensus coding sequences of human breast and colorectal cancers. Science. Oct. 13, 2006;314(5797):268-74. Epub Sep. 7, 2006.
Skretas et al., Regulation of protein activity with small-molecule-controlled inteins. Protein Sci. Feb. 2005;14(2):523-32. Epub Jan. 4, 2005.
Slaymaker et al., Rationally engineered Cas9 nucleases with improved specificity. Science. Jan. 1, 2016;351(6268):84-8. doi: 10.1126/science.aad5227. Epub Dec. 1, 2015.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Diversity in the serine recombinases. Mol Microbiol. Apr. 2002;44(2):299-307. Review.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Sommerfelt et al., Receptor interference groups of 20 retroviruses plating on human cells. Virology. May 1990;176(1):58-69. doi: 10.1016/0042-6822(90)90230-o.
Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.

(56) References Cited

OTHER PUBLICATIONS

Spencer et al., Functional analysis of Fas signaling in vivo using synthetic inducers of dimerization. Curr Biol. Jul. 1m 1996;6(7):839-47. doi: 10.1016/s0960-9822(02)00607-3.

Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.

Stadtman, Selenocysteine. Annu Rev Biochem. 1996;65:83-100.

Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.

Steele et al., The prion protein knockout mouse: a phenotype under challenge. Prion. Apr.-Jun. 2007;1(2):83-93. doi: 10.4161/pri.1.2.4346. Epub Apr. 25, 2007.

Steiner et al., The neurotropic herpes viruses: herpes simplex and varicella-zoster. Lancet Neurol. Nov. 2007;6(11):1015-28. doi: 10.1016/S1474-4422(07)70267-3.

Stella et al., Structure of the Cpf1 endonuclease R-loop complex after target DNA cleavage. Nature. Jun. 22, 2017;546(7659):559-563. doi: 10.1038/nature22398. Epub May 31, 2017.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.

Stephens et al., The landscape of cancer genes and mutational processes in breast cancer. Nature Jun. 2012;486:400-404. doi:10.1038/nature11017.

Sternberg et al., Conformational control of DNA target cleavage by CRISPR-Cas9. Nature. Nov. 5, 2015;527(7576):110-3. doi: 10.1038/nature15544. Epub Oct. 28, 2015.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sterne-Weiler et al., Exon identity crisis: disease-causing mutations that disrupt the splicing code. Genome Biol. Jan. 23, 2014;15(1):201. doi: 10.1186/gb4150.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.

Strecker et al., Engineering of CRISPR-Cas12b for human genome editing. Nat Commun. Jan. 22, 2019;10(1):212. doi: 10.1038/s41467-018-08224-4.

Strecker et al., RNA-guided DNA insertion with CRISPR-associated transposases. Science. Jul. 5, 2019;365(6448):48-53. doi: 10.1126/science.aax9181. Epub Jun. 6, 2019.

Strutt et al., RNA-dependent RNA targeting by CRISPR-Cas9. Elife. Jan. 5, 2018;7:e32724. doi: 10.7554/eLife.32724.

Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.

Sudarsan et al., An mRNA structure in bacteria that controls gene expression by binding lysine. Genes Dev. Nov. 1, 2003;17(21):2688-97.

Sudarsan et al., Riboswitches in eubacteria sense the second messenger cyclic di-GMP. Science. Jul. 18, 2008;321(5887):411-3. doi: 10.1126/science.1159519.

Suess et al., A theophylline responsive riboswitch based on helix slipping controls gene expression in vivo. Nucleic Acids Res. Mar. 5, 2004;32(4):1610-4.

Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.

Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

Sun et al., The CRISPR/Cas9 system for gene editing and its potential application in pain research. Transl Periop & Pain Med. Aug. 3, 2016;1(3):22-33.

Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.

Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.

Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.

Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.

Swarts et al., DNA-guided DNA interference by a prokaryotic Argonaute. Nature. Mar. 13, 2014;507(7491):258-61. doi: 10.1038/nature12971. Epub Feb. 16, 2014.

Swarts et al., The evolutionary journey of Argonaute proteins. Nat Struct Mol Biol. Sep. 2014;21(9):743-53. doi: 10.1038/nsmb.2879.

Szczepek et al., Structure-based redesign of the dimerization interface reduces the toxicity of zinc-finger nucleases. Nat Biotechnol. Jul. 2007;25(7):786-93. Epub Jul. 1, 2007.

Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.

Tagalakis et al., Lack of RNA-DNA oligonucleotide (chimeraplast) mutagenic activity in mouse embryos. Mol Reprod Dev. Jun. 2005;71(2):140-4.

Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.

Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.

Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.

Tambunan et al., Vaccine Design for H5N1 Based on B- and T-cell Epitope Predictions. Bioinform Biol Insights. Apr. 28, 2016;10:27-35. doi: 10.4137/BBI.S38378.

Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.

Tanese et al., Expression of enzymatically active reverse transcriptase in *Escherichia coli*. Proc Natl Acad Sci U S A. Aug. 1985;82(15):4944-8. doi: 10.1073/pnas.82.15.4944.

Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.

Tang et al., Rewritable multi-event analog recording in bacterial and mammalian cells. Science. Apr. 13, 2018;360(6385):eaap8992. doi: 10.1126/science.aap8992. Epub Feb. 15, 2018.

(56) References Cited

OTHER PUBLICATIONS

Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLOS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UniProt Consortium, UniProt: the universal protein knowledgebase. Nucleic Acids Res. Mar. 16, 2018;46(5):2699. doi: 10.1093/nar/gky092.
UniProt Submission; UniProt, Accession No. P01011. Last modified Sep. 18, 2013, version 2. 15 pages.

(56) References Cited

OTHER PUBLICATIONS

UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
UniProtein A0A1V6. Dec. 11, 2019.
Uniprotkb Submission; Accession No. F0NH53. May 3, 2011. 4 pages.
Uniprotkb Submission; Accession No. F0NN87. May 3, 2011. 4 pages.
Uniprotkb Submission; Accession No. G3ECR1.2. No Author Listed., Aug. 12, 2020, 8 pages.
Uniprotkb Submission; Accession No. P0DOC6. No Author Listed., Oct. 5, 2016. 5 pages.
Uniprotkb Submission; Accession No. T0D7A2. Oct. 16, 2013. 10 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (N Y). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Venken et al., Genome-wide manipulations of Drosophila melanogaster with transposons, Flp recombinase, and ΦC31 integrase. Methods Mol Biol. 2012;859:203-28. doi: 10.1007/978-1- 61779-603-6_12.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep, 1, 1998;95(18):10564-9.
Wals et al., Unnatural amino acid incorporation in E. coli: current and future applications in the design of therapeutic proteins. Front Chem. Apr. 1, 2014;2:15. doi: 10.3389/fchem.2014.00015. eCollection 2014.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Biotechniques. 2015:59,201-2;204;206-8.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.

(56) References Cited

OTHER PUBLICATIONS

Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLOS One. 2011;6(5):e19722. doi:10.1371/journal.pone.0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.

Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.

(56) References Cited

OTHER PUBLICATIONS

Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Multiplex nucleotide editing by high-fidelity Cas9 variants with improved efficiency in rice. BMC Plant Biol. 2019;19(1):511. Published Nov. 21, 2019. doi:10.1186/s12870-019-2131-1. Includes supplementary data and materials.
Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121./doi.org/10.1016/j.molcel.2017.02.007.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yamazaki et al., Segmental Isotope Labeling for Protein NMR Using Peptide Splicing. J. Am. Chem. Soc. May 22, 1998; 120(22):5591-2. https://doi.org/10.1021/ja980776o.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yan et al., Functionally diverse type V CRISPR-Cas systems. Science. Jan. 4, 2019;363(6422):88-91. doi: 10.1126/science.aav7271. Epub Dec. 6, 2018.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.
Yang et al., Genome editing with targeted deaminases. BioRxiv. Preprint. First posted online Jul. 28, 2016.
Yang et al., Mutations in SCN9A, encoding a sodium channel alpha subunit, in patients with primary erythermalgia. J Med Genet. Mar. 2004;41(3):171-4. doi: 10.1136/jmg.2003.012153.
Yang et al., One Prime for All Editing. Cell. Dec. 12, 2019;179(7):1448-1450. doi: 10.1016/j.cell.2019.11.030.
Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.
Yang et al., PAM-dependent Target DNA Recognition and Cleavage by C2C1 CRISPR-Cas endonuclease. Cell Dec. 2016;167(7):1814-28.
Yang et al., Permanent genetic memory with >1-byte capacity. Nat Methods. Dec. 2014;11(12):1261-6. doi: 10.1038/nmeth.3147. Epub Oct. 26, 2014.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yang et al., Small-molecule control of insulin and PDGF receptor signaling and the role of membrane attachment. Curr Biol. Jan. 1, 1998;8(1):11-8. doi: 10.1016/s0960-9822(98)70015-6.
Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.
Yang, Nucleases: diversity of structure, function and mechanism. Q Rev Biophys. Feb. 2011;44(1):1-93. doi: 10.1017/S0033583510000181. Epub Sep. 21, 2010.
Yang, PAML 4: phylogenetic analysis by maximum likelihood. Mol Biol Evol. Aug. 2007;24(8):1586-91. doi: 10.1093/molbev/msm088. Epub May 4, 2007.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yasui, Alternative excision repair pathways. Cold Spring Harb Perspect Biol. Jun. 1, 2013;5(6):a012617. doi: 10.1101/cshperspect.a012617.

(56) References Cited

OTHER PUBLICATIONS

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.
Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Liposome-mediated in vivo E1A gene transfer suppressed dissemination of ovarian cancer cells that overexpress HER-2/neu. Oncogene. Oct. 5, 1995;11(7):1383-8.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., II-Clamp-mediated cysteine conjugation. Nat Chem. Feb. 2016;8(2):120-8. doi: 10.1038/nchem.2413. Epub Dec. 21, 2015.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt. 1775. Epub Jan. 19, 2011.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Ribozymes and Riboswitches: Modulation of RNA Function by Small Molecules. Biochemistry. Nov. 2, 2010;49(43):9123-31. doi: 10.1021/bi1012645.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.
Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.
Zheng et al., Highly efficient base editing in bacteria using a Cas9-cytidine deaminase fusion. Commun Biol. Apr. 19, 2018;1:32. doi: 10.1038/s42003-018-0035-5.
Zheng et al., Structural basis for the complete resistance of the human prion protein mutant G127V to prion disease. Sci Rep. Sep. 4, 2018;8(1):13211. doi: 10.1038/s41598-018-31394-6.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zhou et al., Dynamic m(6)A mRNA methylation directs translational control of heat shock response. Nature. Oct. 22, 2015;526(7574):591-4. doi: 10.1038/nature15377. Epub Oct. 12, 2015.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.
Zhou et al., Protective V127 prion variant prevents prion disease by interrupting the formation of dimer and fibril from molecular dynamics simulations. Sci Rep. Feb. 24, 2016;6:21804. doi: 10.1038/srep21804.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Zielenski, Genotype and phenotype in cystic fibrosis. Respiration. 2000;67(2):117-33. doi: 10.1159/000029497.
Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

(56) References Cited

OTHER PUBLICATIONS

Zimmerly et al., Group II intron mobility occurs by target DNA-primed reverse transcription. Cell. Aug. 25, 1995;82(4):545-54. doi: 10.1016/0092-8674(95)90027-6.
Zimmermann et al., Molecular interactions and metal binding in the theophylline-binding core of an RNA aptamer. RNA. May 2000;6(5):659-67.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.
Zuker et al., Optimal computer folding of large RNA sequences using thermodynamics and auxiliary information. Nucleic Acids Res. Jan. 10, 1981;9(1):133-48. doi: 10.1093/nar/9.1.133.
Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.
Zuris et al., Cationic lipid-mediated delivery of proteins enables efficient protein-based genome editing in vitro and in vivo. Nat Biotechnol. 2015;33:73-80.
U.S. Appl. No. 61/874,682, filed Sep. 6, 2013, Liu et al.
U.S. Appl. No. 61/874,746, filed Sep. 6, 2013, Liu et al.
[No Author Listed], EMBL Accession No. Q99ZW2. Nov. 2012. 2 pages.
Addgene Plasmid # 44246. pdCas9-humanized, 2017, Stanley Qi.
Addgene Plasmid # 73021. PCMV-BE3, 2017, David Liu.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Bogdanove et al., TAL effectors: customizable proteins for DNA targeting. Science. Sep. 30, 2011;333(6051):1843-6. doi: 10.1126/science.1204094.
Branden and Tooze, Introduction to Protein Structure. 1999; 2nd edition. Garland Science Publisher: 3-12.
Buchwald et al., Long-term, continuous intravenous heparin administration by an implantable infusion pump in ambulatory patients with recurrent venous thrombosis. Surgery. Oct. 1980;88(4):507-16.
Bulow et al., Multienzyme systems obtained by gene fusion. Trends Biotechnol. Jul. 1991;9(7):226-31.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Cameron, Recent advances in transgenic technology. Mol Biotechnol. Jun. 1997;7(3):253-65.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chichili et al., Linkers in the structural biology of protein-protein interactions. Protein Science. 2013;22:153-67.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cong et al., Multiplex genome engineering using CRISPR/Cas systems. Science. Feb. 15, 2013;339(6121):819-23. doi: 10.1126/science.1231143. Epub Jan. 3, 2013.
Deltcheva et al., CRISPR RNA maturation by trans-encoded small RNA and host factor RNase III. Nature. Mar. 31, 2011;471(7340):602-7. doi: 10.1038/nature09886.
Dicarlo et al., Genome engineering in Saccharomyces cerevisiae using CRISPR-Cas systems. Nucleic Acids Research Apr. 2013;41(7):4336-43.
During et al., Controlled release of dopamine from a polymeric brain implant: in vivo characterization. Ann Neurol. Apr. 1989;25(4):351-6.
Engelward et al., Base excision repair deficient mice lacking the Aag alkyladenine DNA glycosylase. Proc Natl Acad Sci U S A. Nov. 25, 1997;94(24):13087-92.
Esvelt et al., A system for the continuous directed evolution of biomolecules. Nature. Apr. 28, 2011;472(7344):499-503. doi: 10.1038/nature09929. Epub Apr. 10, 2011.
Ferretti et al., Complete genome sequence of an M1 strain of *Streptococcus pyogenes*. Proc Natl Acad Sci U S A. Apr. 10, 2001;98(8):4658-63.
Freshney, Culture of Animal Cells. A Manual of Basic Technique. Alan R. Liss, Inc. New York. 1983;4.
Fukui et al., DNA Mismatch Repair in Eukaryotes and Bacteria. J Nucleic Acids. Jul. 27, 2010;2010. pii: 260512. doi: 10.4061/2010/260512.
Gardlik et al., Vectors and delivery systems in gene therapy. Med Sci Monit. Apr. 2005;11(4):RA110-21. Epub Mar. 24, 2005.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of A•T to G•C in genomic DNA without DNA cleavage. Nature. Nov. 23, 2017;551(7681):464-471. doi: 10.1038/nature24644. Epub Oct. 25, 2017. Erratum in: Nature. May 2, 2018.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerber et al., An adenosine deaminase that generates inosine at the wobble position of tRNAs. Science. Nov. 5, 1999;286(5442):1146-9. doi: 10.1126/science.286.5442.1146.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.and supplemental pages.
Guo et al., Protein tolerance to random amino acid change. Proc Natl Acad Sci U S A. Jun. 22, 2004;101(25):9205-10. Epub Jun. 14, 2004.
Hill et al., Functional analysis of conserved histidines in ADP-glucose pyrophosphorylase from *Escherichia coli*.Biochem Biophys Res Commun. Mar. 17, 1998;244(2):573-7.
Houdebine, The methods to generate transgenic animals and to control transgene expression. J Biotechnol. Sep. 25, 2002;98(2-3):145-60.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

(56) References Cited

OTHER PUBLICATIONS

International Search Report and Written Opinion dated Apr. 11, 2019 in connection with PCT/US2018/056146.
Invitation to Pay Additional Fees mailed Feb. 20, 2019 in connection with PCT/US2018/056146.
International Prelminary Report on Patentability dated Apr. 30, 2020 in connection with PCT/US2018/056146.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Kappel et al., Regulating gene expression in transgenic animals. Curr Opin Biotechnol. Oct. 1992;3(5):548-53.
Kaya et al., A bacterial Argonaute with noncanonical guide RNA specificity. Proc. Natl. Acad. Sci. USA Apr. 2016;113(15):4057-62.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Kleinstiver et al., Broadening the targeting range of Staphylococcus aureus CRISPR-Cas9 by modifying PAM recognition. Nat Biotechnol. Dec. 2015;33(12):1293-1298. doi: 10.1038/nbt.3404. Epub Nov. 2, 2015.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. May 19, 2016;533(7603):420-4.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Krokan et al., Uracil in DNA—moccurrence, consequences and repair. Oncogene. Dec. 16, 2002;21(58):8935-48. doi: 10.1038/sj.onc.1205996. PMID: 12483510.
Kundu et al., Leucine to proline substitution by SNP at position 197 in Caspase-9 gene expression leads to neuroblastoma: a bioinformatics analysis. 3 Biotech. 2013; 3:225-34.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Langer et al., New methods of drug delivery. Science. Sep. 28, 1990;249(4976):1527-33.
Lau et al., Molecular basis for discriminating between normal and damaged bases by the human alkyladenine glycosylase, AAG. Proc Natl Acad Sci U S A. Dec. 5, 2000;97(25):13573-8.
Lazar et al., Transforming growth factor alpha: mutation of aspartic acid 47 and leucine 48 results in different biological activities. Mol Cell Biol. Mar. 1988;8(3):1247-52.
Lee et al., PIK3CA gene is frequently mutated in breast carcinomas and hepatocellular carcinomas. Oncogene. Feb. 17, 2005;24(8):1477-80.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Inhibition of calcification of bioprosthetic heart valves by local controlled-release diphosphonate. Science. Apr. 12, 1985;228(4696):190-2.
Lewis et al., Building the Class 2 CRISPR-Cas Arsenal. Mol Cell 2017;65(3);377-379.
Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Highly efficient and precise base editing in discarded human tripronuclear embryos. Protein Cell. Aug. 19, 2017. doi: 10.1007/s13238-017-0458-7. [Epub ahead of print].
Liang et al., Correction of β-thalassemia mutant by base editor in human embryos. Protein Cell. Nov. 2017;8(11):811-822. doi: 10.1007/s13238-017-0475-6. Epub Sep. 23, 2017. PMID: 28942539; PMCID: PMC5676594.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Lyons et al., Efficient recognition of an unpaired lesion by a DNA repair glycosylase. J Am Chem Soc. Dec. 16, 2009;131(49):17742-3.
Ma et al., Targeted AID-mediated mutagenesis (TAM) enables efficient genomic diversification in mammalian cells. Nature Methods. Oct. 2016;13:1029-35. doi:10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
MacBeth et al., Inositol hexakisphosphate is bound in the ADAR2 core and required for RNA editing. Science. Sep. 2, 2005;309(5740):1534-9. doi: 10.1126/science.1113150.
Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).
Mali et al., Cas9 as a versatile tool for engineeringbiology. Nat Methods. Oct. 2013;10(10):957-63. doi: 10.1038/nmeth.2649.

(56) References Cited

OTHER PUBLICATIONS

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Mullins et al., Transgenesis in nonmurine species. Hypertension. Oct. 1993;22(4):630-3.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth. 4262.
Phillips, The challenge of gene therapy and DNA delivery. J Pharm Pharmacol. Sep. 2001;53(9):1169-74.
Plosky et al., CRISPR-Mediated Base Editing without DNA Double-Strand Breaks. Mol Cell. May 19, 2016;62(4):477-8. doi: 10.1016/j.molcel.2016.05.006.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.
Qi et al., Repurposing CRISPR as an RNA-guided platform for sequence-specific control of gene expression. Cell. Feb. 28, 2013;152(5):1173-83. doi: 10.1016/j.cell.2013.02.022.
Rees et al., Improving the DNA specificity and applicability of base editing through protein engineering and protein delivery. Nat Commun. Jun. 6, 2017;8:15790. doi: 10.1038/ncomms15790.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Sang, Prospects for transgenesis in the chick. Mech Dev. Sep. 2004;121(9):1179-86.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Satomura et al., Precise genome-wide base editing by the CRISPR Nickase system in yeast. Sci Rep. May 18, 2017;7(1):2095. doi: 10.1038/s41598-017-02013-7. Erratum in: Sci Rep. Sep. 27, 2017;7(1):12354.
Saudek et al., A preliminary trial of the programmable implantable medication system for insulin delivery. N Engl J Med. Aug. 31, 1989;321(9):574-9.
Sefton et al., Implantable pumps. Crit Rev Biomed Eng. 1987;14(3):201-40.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shmakov et al., Discovery and Functional Characterization of Diverse Class 2 CRISPR Cas Systems. Molecular Cell Nov. 2015;60(3):385-97.

Tang et al., Aptazyme-embedded guide RNAs enable ligand-responsive genome editing and transcriptional activation. Nat Commun. Jun. 28, 2017;8:15939. doi: 10.1038/ncomms15939.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6. Erratum in: Lancet Jul. 13, 2002;360(9327):176.
Traxler et al., A genome-editing strategy to treat ?- hemoglobinopathies that recapitulates a mutation associated with a benign genetic condition. Nat Med. Sep. 2016;22(9):987-90. doi: 10.1038/nm. 4170. Epub Aug. 15, 2016.
Tsai et al., GUIDE-seq enables genome-wide profiling of off-target cleavage by CRISPR-Cas nucleases. Nat Biotechnol. Feb. 2015;33(2):187-197. doi: 10.1038/nbt.3117. Epub Dec. 16, 2014.
Uniprot Submission; UniProt, Accession No. PO1011. Last modified Jun. 11, 2014, version 2. 15 pages.
Vik et al., Endonuclease V cleaves at inosines in RNA. Nat Commun. 2013;4:2271. doi: 10.1038/ncomms3271.
Wacey et al., Disentangling the perturbational effects of amino acid substitutions in the DNA-binding domain of p53. Hum Genet. Jan. 1999;104(1):15-22.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wolf et al., tadA, an essential tRNA-specific adenosine deaminase from *Escherichia coli*. EMBO J. Jul. 15, 2002;21(14):3841-51.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330.
Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x. Erratum in: Protein Cell. May 13, 2019.
Yang et al., New CRISPR-Cas systems discovered. Cell Res. Mar. 2017;27(3):313-314. doi: 10.1038/cr.2017.21. Epub Feb. 21, 2017.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Stabilized plasmid-lipid particles for regional gene therapy: formulation and transfection properties. Gene Ther. Aug. 1999;6(8):1438-47.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 62/288,661, filed Jan. 29, 2016, Muir et al.

(56) References Cited

OTHER PUBLICATIONS

U.S. Appl. No. 62/357,332, filed Jun. 30, 2016, Liu et al.
[No Author Listed], *Mus musculus* (Mouse). UniProtKB Accession No. P51908 (ABEC1_MOUSE). Oct. 1, 1996. 10 pages.
Aida et al., Prime editing primarily incudes undesired outcomes in mice. bioRxiv preprint and Supplemental Information. Aug. 6, 2020. Retrieved from www.biorxiv.org. doi: 10.1101/2020.08.06. 239723. 40 pages.
Asokan et al., The AAV vector toolkit: poised at the clinical crossroads. Mol Ther. Apr. 2012;20(4):699-708. doi: 10.1038/mt. 2011.287. Epub Jan. 24, 2012.
Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.
Baba et al., Construction of *Escherichia coli* K-12 in-frame, single-gene knockout mutants: the Keio collection. Mol Syst Biol. 2006;2:2006. 0008. doi: 10.1038/msb4100050. Epub Feb. 21, 2006.
Badran et al., In vivo continuous directed evolution. Curr Opin Chem Biol. Feb. 2015;24:1-10. doi: 10.1016/j.cbpa.2014.09.040. Epub Nov. 7, 2014.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Barmania et al., C-C chemokine receptor type five (CCR5): An emerging target for the control of HIV infection. Appl Transl Genom. May 26, 2013;2:3-16. doi: 10.1016/j.atg.2013.05.004.
Bass, B.L., RNA editing by adenosine deaminases that act on RNA. Annu Rev Biochem. 2002;71:817-46. doi: 10.1146/annurev.biochem. 71.110601.135501. Epub Nov. 9, 2001.
Beaudry et al., Directed evolution of an RNA enzyme. Science. Jul. 31, 1992;257(5070):635-41. doi: 10.1126/science.1496376.
Bell et al., Ribozyme-catalyzed excision of targeted sequences from within RNAs. Biochemistry. Dec. 24, 2002;41(51):15327-33. doi: 10.1021/bi0267386.
Bentin, T., A ribozyme transcribed by a ribozyme. Artif DNA PNA XNA. Apr. 2011;2(2):40-42. doi: 10.4161/adna.2.2.16852.
Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Brierley et al., Viral RNA pseudoknots: versatile motifs in gene expression and replication. Nat Rev Microbiol. Aug. 2007;5(8):598-610. doi: 10.1038/nrmicro1704.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.
Chen et al., Alterations in PMS2, MSH2 and MLH1 expression in human prostate cancer. Int J Oncol. May 2003;22(5):1033-43.

Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Davis et al., Assaying Repair at DNA Nicks. Methods Enzymol. 2018;601:71-89. doi: 10.1016/bs.mie.2017.12.001. Epub Feb. 1, 2018.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De La Peña et al., The Hammerhead Ribozyme: A Long History for a Short RNA. Molecules. Jan. 4, 2017;22(1):78. doi: 10.3390/molecules22010078.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Dolan et al., Trans-splicing with the group I intron ribozyme from Azoarcus. RNA. Feb. 2014;20(2):202-13. doi: 10.1261/rna.041012. 113. Epub Dec. 16, 2013.
Doudna, The promise and challenge of therapeutic genome editing. Nature. Feb. 2020;578(7794):229-236. doi: 10.1038/s41586-020-1978-5. Epub Feb. 12, 2020.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Eisenberg et al., A-to-I RNA editing—immune protector and transcriptome diversifier. Nat Rev Genet. Aug. 2018;19(8):473-490. doi: 10.1038/s41576-018-0006-1.
Estacion et al., A sodium channel gene SCN9A polymorphism that increases nociceptor excitability. Ann Neurol. Dec. 2009;66(6):862-6. doi: 10.1002/ana.21895.

(56) References Cited

OTHER PUBLICATIONS

Filippova et al., Guide RNA modification as a way to improve CRISPR/Cas9-based genome- editing systems. Biochimie. Dec. 2019;167:49-60. doi: 10.1016/j.biochi.2019.09.003. Epub Sep. 4, 2019.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.
Genbank Submission; NIH/NCBI Accession No. 4UN5_B. Anders et al., Jul. 23, 2014. 5 pages.
Genbank Submission; NIH/NCBI, Accession No. AIT42264.1. Hyun et al., Oct. 15, 2014. 2 pages.
Genbank Submission; NIH/NCBI, Accession No. AKA60242.1. Tong et al., Apr. 5, 2015. 1 page.
Genbank Submission; NIH/NCBI, Accession No. AKQ21048.1. Gilles et al., Jul. 19, 2015. 1 page.
Genbank Submission; NIH/NCBI, Accession No. AKS40380.1. Nodvig et al., Aug. 2, 2015. 1 page.
Genbank Submission; NIH/NCBI, Accession No. NG_008692.2. McClintock et al., Aug. 27, 2018. 33 pages.
Genbank Submission; NIH/NCBI, Accession No. NP_001075493.1. Schiaffella et al., Jun. 24, 2018. 2 pages.
Genbank Submission; NIH/NCBI, Accession No. NP_001157741.1. Zeng et al., Sep. 17, 2018. 3 pages.
Genbank Submission; NIH/NCBI, Accession No. NP_001157742.1. Zeng et al., Oct. 21, 2018. 3 pages.
Genbank Submission; NIH/NCBI, Accession No. NP_033040.2. Liu et al., Jun. 23, 2018. 2 pages.
Genbank Submission; NIH/NCBI, Accession No. WP_002989955.1. No Author Listed, May 6, 2013. 1 page.
Genbank Submission; NIH/NCBI, Accession No. WP_010922251.1. No Author Listed, May 15, 2013. 1 page.
Genbank Submission; NIH/NCBI, Accession No. WP_011054416.1. No Author Listed, May 15, 2013. 1 page.
Genbank Submission; NIH/NCBI, Accession No. WP_011284745.1. No Author Listed, May 16, 2013. 1 page.
Genbank Submission; NIH/NCBI, Accession No. WP_011285506.1. No Author Listed, May 16, 2013. 1 page.
Genbank Submission; NIH/NCBI, Accession No. WP_011527619.1. No Author Listed, May 16, 2013. 1 page.
Genbank Submission; NIH/NCBI, Accession No. WP_012560673.1. No Author Listed, May 17, 2013. 1 page.
Genbank Submission; NIH/NCBI, Accession No. WP_014407541.1. No Author Listed, May 18, 2013. 1 page.
Genbank Submission; NIH/NCBI, Accession No. WP_020905136.1. No Author Listed, Jul. 25, 2013. 1 page.
Genbank Submission; NIH/NCBI, Accession No. WP_023080005.1. No Author Listed, Oct. 27, 2013. 1 page.
Genbank Submission; NIH/NCBI, Accession No. WP_023610282.1. No Author Listed, Nov. 27, 2013. 1 page.
Genbank Submission; NIH/NCBI, Accession No. WP_030125963.1. No Author Listed, Jul. 9, 2014. 1 page.
Genbank Submission; NIH/NCBI, Accession No. WP_030126706.1. No Author Listed, Jul. 9, 2014. 1 page.
Genbank Submission; NIH/NCBI, Accession No. WP_031488318.1. No Author Listed., Aug. 5, 2014. 1 page.
Genbank Submission; NIH/NCBI, Accession No. WP_032460140.1. No Author Listed, Oct. 4, 2014. 1 page.
Genbank Submission; NIH/NCBI, Accession No. WP_032461047.1. No Author Listed, Oct. 4, 2014. 1 page.
Genbank Submission; NIH/NCBI, Accession No. WP_032462016.1. Haft et al., Oct. 4, 2014. 1 page.
Genbank Submission; NIH/NCBI, Accession No. WP_032462936.1. No Author Listed, Oct. 4, 2014. 1 page.
Genbank Submission; NIH/NCBI, Accession No. WP_032464890.1. No Author Listed, Oct. 4, 2014. 1 page.
Genbank Submission; NIH/NCBI, Accession No. WP_038431314.1. No Author Listed, Dec. 26, 2014. 1 page.
Genbank Submission; NIH/NCBI, Accession No. WP_038432938.1. No Author Listed, Dec. 26, 2014. 1 page.
Genbank Submission; NIH/NCBI, Accession No. WP_038434062.1. No Author Listed, Dec. 26, 2014. 1 page.
Genbank Submission; NIH/NCBI, Accession No. WP_048327215.1. No Author Listed, Jun. 26, 2015. 1 page.
Genbank Submission; NIH/NCBI, Accession No. WP_049519324.1. No Author Listed, Jul. 20, 2015. 1 page.
Genbank Submission; NIH/NCBI, Accession No. XP_003314669.1. No Author Listed, Mar. 20, 2018. 2 pages.
Genbank Submission; NIH/NCBI, Accession No. XP_026671085.1. No Author Listed, Oct. 17, 2018. 1 page.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Guedon et al., Current gene therapy using viral vectors for chronic pain. Mol Pain. May 13, 2015;11:27. doi: 10.1186/s12990-015-0018-1.
Guo et al., Evolution of Tetrahymena ribozyme mutants with increased structural stability. Nat Struct Biol. Nov. 2002;9(11):855-61. doi: 10.1038/nsb850.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Halbert et al., Repeat transduction in the mouse lung by using adeno-associated virus vectors with different serotypes. J Virol. Feb. 2000; 74(3):1524-32. doi: 10.1128/jvi.74.3.1524-1532.2000.
Hardt et al.,Missense variants in hMLH1 identified in patients from the German HNPCC consortium and functional studies. Fam Cancer. Jun. 2011;10(2):273-84. doi: 10.1007/s10689-011-9431-4.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.
Hua et al., Expanding the base editing scope in rice by using Cas9 variants. Plant Biotechnol J. Feb. 2019;17(2):499-504. doi: 10.1111/pbi.12993. Epub Oct. 5, 2018.
Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Isaacs et al., Engineered riboregulators enable post-transcriptional control of gene expression. Nat Biotechnol. Jul. 2004;22(7):841-7. doi: 10.1038/nbt986. Epub Jun. 20, 2004.
Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.
Johnson et al., Trans insertion-splicing: ribozyme-catalyzed insertion of targeted sequences into RNAs. Biochemistry. Aug. 9, 2005;44(31):10702-10. doi: 10.1021/bi0504815.
Kan et al., Mechanisms of precise genome editing using oligonucleotide donors. Genome Res. Jul. 2017;27(7):1099-1111. doi: 10.1101/gr.214775.116. Epub Mar. 29, 2017.

(56) References Cited

OTHER PUBLICATIONS

Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.

Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.

Kim et al., RAD51 mutants cause replication defects and chromosomal instability. Mol Cell Biol. Sep. 2012;32(18):3663-80. doi: 10.1128/MCB.00406-12. Epub Jul. 9, 2012.

King et al., No gain, No pain: NaV1.7 as an analgesic target. ACS Chem Neurosci. Sep. 17, 2014;5(9):749-51. doi: 10.1021/cn500171p. Epub Aug. 11, 2014.

Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.

Kumar et al., Gene therapy for chronic neuropathic pain: how does it work and where do we stand today? Pain Med. May 2011;12(5):808-22. doi: 10.1111/j.1526-4637.2011.01120.x.

Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.

Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.

Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.

Liao et al., One-step assembly of large CRISPR arrays enables multi-functional targeting and reveals constraints on array design. bioRxiv. May 2, 2018. doi: 10.1101/312421. 45 pages.

Liefke et al., The oxidative demethylase ALKBH3 marks hyperactive gene promoters in human cancer cells. Genome Med. Jun. 30, 2015;7(1):66. doi: 10.1186/s13073-015-0180-0.

Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.

Lindahl, T., Instability and decay of the primary structure of DNA. Nature. Apr. 22, 1993;362(6422):709-15. doi: 10.1038/362709a0.

Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.

Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.

Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.

Marsden et al., The Tumor-Associated Variant RAD51 G151D Induces a Hyper-Recombination Phenotype. PLOS Genet. Aug. 11, 2016;12(8):e1006208. doi: 10.1371/journal.pgen.1006208.

Martz, L., Nav-i-gating antibodies for pain. Science-Business eXchange. Jun. 11, 2014;7(662):1-2. doi: 10.1038/scibx.2014.662.

Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Mootz et al., Protein splicing triggered by a small molecule. J Am Chem Soc. Aug. 7, 2002;124(31):9044-5 and Supporting Information. doi: 10.1021/ja0267690. 4 pages.

Muller, U.F., Design and Experimental Evolution of trans-Splicing Group I Intron Ribozymes. Molecules. Jan. 2, 2017;22(1):75. doi: 10.3390/molecules22010075.

Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.

Nelson et al., The unstable repeats—three evolving faces of neurological disease. Neuron. Mar. 6, 2013;77(5):825-43. doi: 10.1016/j.neuron.2013.02.022.

Noack et al., Epitranscriptomics: A New Regulatory Mechanism of Brain Development and Function. Front Neurosci. Feb. 20, 2018;12:85. doi: 10.3389/fnins.2018.00085. 9 pages.

Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.

Perreault et al., Mixed deoxyribo- and ribo-oligonucleotides with catalytic activity. Nature. Apr. 5, 1990;344(6266):565-7. doi: 10.1038/344565a0.

Pieken et al., Kinetic characterization of ribonuclease-resistant 2'-modified hammerhead ribozymes. Science. Jul. 19, 1991;253(5017):314-7. doi: 10.1126/science.1857967.

Prasad et al., Visualizing the assembly of human Rad51 filaments on double-stranded Dna. J Mol Biol. Oct. 27, 2006;363(3):713-28. doi: 10.1016/j.jmb.2006.08.046. Epub Aug. 22, 2006.

Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.

Raillard et al., Targeting sites within HIV-1 cDNA with a DNA-cleaving ribozyme. Biochemistry. Sep. 10, 1996;35(36):11693-701. doi: 10.1021/bi960845g.

Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.

Richardson et al., Frequent chromosomal translocations induced by DNA double-strand breaks. Nature. Jun. 8, 2000;405(6787):697-700. doi: 10.1038/35015097.

Robertson et al., Selection in vitro of an RNA enzyme that specifically cleaves single-stranded DNA. Nature. Mar. 29, 1990;344(6265):467-8. doi: 10.1038/344467a0.

Safari et al., CRISPR Cpf1 proteins: structure, function and implications for genome editing. Cell Biosci. May 9, 2019;9:36. doi: 10.1186/s13578-019-0298-7.

Samanta et al., A reverse transcriptase ribozyme. Elife. Sep. 26, 2017;6:e31153. doi: 10.7554/eLife.31153.

San Filippo et al., Mechanism of eukaryotic homologous recombination. Annu Rev Biochem. 2008;77:229-57. doi: 10.1146/annurev.biochem.77.061306.125255.

Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.

Score Results for Luetticken et al., Complete genome sequence of a Streptococcus dysgalactiae subsp. RT equisimilis strain possessing Lancefield's group A antigen. RL Submitted to the EMBL/GenBank/DDBJ databases. May 2012. 3 pages.

Score Results for Okumura et al., Evolutionary paths of streptococcal and staphylococcal superantigens. RL BMC Genomics. 2012;13:404-404. 3 pages.

Score Results for SHIMOMURA et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.

Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.

(56) References Cited

OTHER PUBLICATIONS

Shechner et al., Multiplexable, locus-specific targeting of long RNAs with CRISPR-Display. Nat Methods. Jul. 2015; 12(7):664-70. doi: 10.1038/nmeth.3433. Epub Jun. 1, 2015.
Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.
Song et al., RS-1 enhances CRISPR/Cas9- and TALEN-mediated knock-in efficiency. Nat Commun. Jan. 28, 2016;7:10548. doi: 10.1038/ncomms10548.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Sullenger et al., Ribozyme-mediated repair of defective mRNA by targeted, trans-splicing. Nature. Oct. 13, 1994;371(6498):619-22. doi: 10.1038/371619a0.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Teng et al., Mutational analysis of apolipoprotein B mRNA editing enzyme (APOBEC1). structure-function relationships of RNA editing and dimerization. J Lipid Res. Apr. 1999;40(4):623-35.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Trojan et al., Functional analysis of hMLH1 variants and HNPCC-related mutations using a human expression system. Gastroenterology. Jan. 2002;122(1):211-9. doi: 10.1053/gast.2002.30296.
Usman et al., Exploiting the chemical synthesis of RNA. Trends Biochem Sci. Sep. 1992;17(9):334-9. doi: 10.1016/0968-0004(92)90306-t.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 2020.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Wu et al., A novel SCN9A mutation responsible for primary erythromelalgia and is resistant to the treatment of sodium channel blockers. PLOS One. 2013;8(1):e55212. doi: 10.1371/journal.pone.0055212. Epub Jan. 31, 2013. 15 pages.
Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.
Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yu et al., Dynamic control of Rad51 recombinase by self-association and interaction with BRCA2. Mol Cell. Oct. 2003;12(4):1029-41. doi: 10.1016/s1097-2765(03)00394-0.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
U.S. Appl. No. 17/289,665, filed Apr. 28, 2021, Liu et al.
U.S. Appl. No. 16/772,747, filed Jun. 12, 2020, Shen et al.
U.S. Appl. No. 17/425,261, filed Jul. 22, 2021, Kim et al.
U.S. Appl. No. 17/057,398, filed Nov. 20, 2020, Liu et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/294,287, filed May 14, 2021, Liu et al.
U.S. Appl. No. 17/288,504, filed Apr. 23, 2021, Liu et al.
U.S. Appl. No. 17/633,573, filed Feb. 7, 2022, Liu et al.
U.S. Appl. No. 17/436,048, filed Sep. 2, 2021, Liu et al.
U.S. Appl. No. 17/219,590, filed Mar. 31, 2021, Liu et al.
U.S. Appl. No. 17/603,917, filed Oct. 14, 2021, Liu et al.
U.S. Appl. No. 17/797,700, filed Aug. 4, 2022, Liu et al.
U.S. Appl. No. 17/602,738, filed Oct. 8, 2021, Liu et al.
U.S. Appl. No. 17/613,025, filed Nov. 19, 2021, Liu et al.
U.S. Appl. No. 17/300,668, filed Sep. 17, 2021, Liu et al.
U.S. Appl. No. 17/795,819, filed Jul. 27, 2022, Liu et al.
U.S. Appl. No. 17/779,953, filed May 25, 2022, Liu et al.
U.S. Appl. No. 17/767,777, filed Apr. 8, 2022, Liu et al.
U.S. Appl. No. 17/797,701, filed Aug. 4, 2022, Liu et al.
U.S. Appl. No. 17/797,697, filed Aug. 4, 2022, Liu et al.
U.S. Appl. No. 17/219,635, filed Mar. 31, 2021, Liu et al.
U.S. Appl. No. 17/219,672, filed Mar. 31, 2021, Liu et al.
U.S. Appl. No. 17/751,599, filed May 23, 2022, Liu et al.
U.S. Appl. No. 17/440,682, filed Sep. 17, 2021, Liu et al.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 17/160,329, filed Jan. 27, 2021, Liu et al.
U.S. Appl. No. 14/462,163, filed Aug. 18, 2014, Liu et al.

(56) References Cited

OTHER PUBLICATIONS

U.S. Appl. No. 14/462,189, filed Aug. 18, 2014, Liu etal.
U.S. Appl. No. 14/916,679, filed Mar. 4, 2016, Liu et al.
U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 17/103,233, filed Nov. 24, 2020, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 17/688,416, filed Mar. 7, 2022, Liu et al.
U.S. Appl. No. 14/325,815, filed Jul. 8, 2014, Liu et al.
U.S. Appl. No. 14/326,109, filed Jul. 8, 2014, Liu etal.
U.S. Appl. No. 14/326,140, filed Jul. 8, 2014, Liu etal.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 17/408,306, filed Aug. 20, 2021, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 17/527,011, filed Nov. 15, 2021, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 15/852,52, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 16/492,548, filed Sep. 9, 2019, Maianti et al.
U.S. Appl. No. 15/784,033, filed Oct. 13, 2017, Liu et al.
U.S. Appl. No. 17/692,925, filed Mar. 11, 2022, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 17/586,688, filed Jan. 27, 2022, Liu et al.
U.S. Appl. No. 16/643,376, filed Feb. 28, 2020, Liu et al.
U.S. Appl. No. 17/700,109, filed Mar. 21, 2022, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/976,047, filed Aug. 26, 2020, Liu et al.
U.S. Appl. No. 17/593,020, filed Sep. 3, 2021, Church et al.

Untreated

| Site 2 | G1 | A2 | G3 | T4 | A5 | T6 | G7 | A8 | G9 | G10 | C11 | A12 | T13 | A14 | G15 | A16 | C17 | T18 | G19 | C20 | Indel% |
|---|---|---|---|---|---|---|---|---|---|---|---|---|---|---|---|---|---|---|---|---|---|
| A | 0.0 | 100.0 | 0.0 | 0.0 | 99.8 | 0.0 | 0.1 | 99.9 | 0.1 | 0.0 | 0.0 | 99.9 | 0.0 | 100.0 | 0.0 | 99.9 | 0.0 | 0.0 | 0.0 | 0.0 | 0.04 |
| C | 0.0 | 0.0 | 0.0 | 0.0 | 0.0 | 0.0 | 0.1 | 0.0 | 0.0 | 0.0 | 100.0 | 0.1 | 0.0 | 0.0 | 0.0 | 0.0 | 100.0 | 0.0 | 0.0 | 99.9 | |
| G | 99.9 | 0.0 | 100.0 | 0.0 | 0.0 | 0.0 | 98.9 | 0.0 | 99.9 | 99.9 | 0.0 | 0.0 | 0.0 | 0.0 | 100.0 | 0.1 | 0.0 | 0.0 | 100.0 | 0.1 | |
| T | 0.0 | 0.0 | 0.0 | 100.0 | 0.2 | 100.0 | 0.0 | 0.1 | 0.1 | 0.1 | 0.0 | 0.0 | 100.0 | 0.0 | 0.0 | 0.0 | 0.0 | 100.0 | 0.0 | 0.0 | |
| # reads | 79412 | 79157 | 80195 | 78765 | 79632 | 79506 | 79440 | 75464 | 79090 | 78891 | 79856 | 79726 | 79885 | 79532 | 80250 | 79055 | 79321 | 80329 | 79592 | 80258 | |

ABE7.10

| Site 2 | G1 | A2 | G3 | T4 | A5 | T6 | G7 | A8 | G9 | G10 | C11 | A12 | T13 | A14 | G15 | A16 | C17 | T18 | G19 | C20 | Indel% |
|---|---|---|---|---|---|---|---|---|---|---|---|---|---|---|---|---|---|---|---|---|---|
| A | 0.1 | 99.9 | 0.0 | 0.0 | 38.5 | 0.0 | 0.2 | 97.5 | 0.0 | 0.0 | 0.0 | 99.8 | 0.0 | 100.0 | 0.1 | 100.0 | 0.0 | 0.0 | 0.0 | 0.0 | 0.1 |
| C | 0.0 | 0.0 | 0.0 | 0.0 | 0.0 | 0.0 | 0.0 | 0.0 | 0.0 | 0.0 | 100.0 | 0.1 | 0.0 | 0.0 | 0.0 | 0.0 | 99.9 | 0.0 | 0.0 | 99.9 | |
| G | 99.9 | 0.1 | 100.0 | 0.0 | 61.5 | 0.0 | 99.7 | 2.5 | 99.9 | 99.9 | 0.0 | 0.0 | 0.0 | 0.0 | 99.9 | 0.0 | 0.0 | 0.1 | 99.9 | 0.1 | |
| T | 0.1 | 0.0 | 0.0 | 100.0 | 0.0 | 100.0 | 0.1 | 0.0 | 0.1 | 0.0 | 0.0 | 0.0 | 100.0 | 0.0 | 0.0 | 0.0 | 0.0 | 100.0 | 0.1 | 0.0 | |
| # reads | 22790 | 22746 | 23143 | 23062 | 23157 | 22753 | 23138 | 22949 | 22997 | 22914 | 23101 | 23119 | 23148 | 23061 | 23104 | 23198 | 23161 | 23252 | 23185 | 23102 | |

ABE7.9

| Site 2 | G1 | A2 | G3 | T4 | A5 | T6 | G7 | A8 | G9 | G10 | C11 | A12 | T13 | A14 | G15 | A16 | C17 | T18 | G19 | C20 | Indel% |
|---|---|---|---|---|---|---|---|---|---|---|---|---|---|---|---|---|---|---|---|---|---|
| A | 0.1 | 99.8 | 0.0 | 0.0 | 40.8 | 0.0 | 0.2 | 87.2 | 0.0 | 0.0 | 0.0 | 99.9 | 0.0 | 100.0 | 0.0 | 100.0 | 0.0 | 0.0 | 0.0 | 0.0 | 0.04 |
| C | 0.0 | 0.0 | 0.0 | 0.0 | 0.0 | 0.0 | 0.0 | 0.0 | 0.0 | 0.0 | 100.0 | 0.1 | 0.0 | 0.0 | 0.0 | 0.0 | 100.0 | 0.0 | 0.0 | 99.9 | |
| G | 99.9 | 0.2 | 100.0 | 0.0 | 59.2 | 0.0 | 99.8 | 12.7 | 100.0 | 100.0 | 0.0 | 0.0 | 0.0 | 0.0 | 100.0 | 0.0 | 0.0 | 0.0 | 100.0 | 0.0 | |
| T | 0.0 | 0.0 | 0.0 | 100.0 | 0.0 | 100.0 | 0.0 | 0.0 | 0.0 | 0.0 | 0.0 | 0.0 | 100.0 | 0.0 | 0.0 | 0.0 | 0.0 | 100.0 | 0.0 | 0.0 | |
| # reads | 89524 | 88328 | 90444 | 87953 | 89654 | 88912 | 89677 | 85225 | 88642 | 88383 | 89480 | 89959 | 90210 | 89612 | 90654 | 89284 | 89636 | 90696 | 89947 | 90327 | |

FIG. 5C

Untreated

| Site 6 | G1 | G2 | A3 | T4 | T5 | G6 | A7 | C8 | C9 | C10 | A11 | G12 | G13 | C14 | C15 | A16 | G17 | G18 | G19 | C20 | Indel% |
|---|---|---|---|---|---|---|---|---|---|---|---|---|---|---|---|---|---|---|---|---|---|
| A | 0.0 | 0.0 | 100.0 | 0.0 | 0.0 | 0.1 | 99.8 | 0.0 | 0.0 | 0.0 | 100.0 | 0.0 | 0.0 | 0.0 | 0.0 | 100.0 | 0.0 | 0.0 | 0.0 | 0.0 | 0.02 |
| C | 0.0 | 0.0 | 0.0 | 0.0 | 0.0 | 0.0 | 0.0 | 100.0 | 0.0 | 100.0 | 0.0 | 0.0 | 0.0 | 100.0 | 99.9 | 0.0 | 0.0 | 0.0 | 0.0 | 100.0 | |
| G | 100.0 | 100.0 | 0.0 | 0.0 | 0.0 | 99.9 | 0.0 | 0.0 | 100.0 | 0.0 | 0.0 | 100.0 | 100.0 | 0.0 | 0.0 | 0.0 | 100.0 | 100.0 | 100.0 | 0.0 | |
| T | 0.0 | 0.0 | 0.0 | 100.0 | 100.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | |
| # reads | 90113 | 89408 | 90006 | 88268 | 87871 | 88602 | 87635 | 89461 | 89989 | 89962 | 91062 | 90421 | 90010 | 87725 | 88240 | 91470 | 90705 | 91217 | 91276 | 90127 | |

ABE7.10

| Site 6 | G1 | G2 | A3 | T4 | T5 | G6 | A7 | C8 | C9 | C10 | A11 | G12 | G13 | C14 | C15 | A16 | G17 | G18 | G19 | C20 | Indel% |
|---|---|---|---|---|---|---|---|---|---|---|---|---|---|---|---|---|---|---|---|---|---|
| A | 0.0 | 0.0 | 92.8 | 0.0 | 0.0 | 0.0 | 37.1 | 0.0 | 0.0 | 0.0 | 97.5 | 0.0 | 0.0 | 0.0 | 0.0 | 100.0 | 0.1 | 0.0 | 0.0 | 0.0 | 0.05 |
| C | 0.0 | 0.0 | 0.0 | 0.0 | 0.0 | 0.0 | 0.0 | 99.9 | 0.0 | 99.9 | 0.0 | 0.0 | 0.0 | 100.0 | 100.0 | 0.0 | 0.0 | 0.0 | 0.0 | 100.0 | |
| G | 100.0 | 100.0 | 7.2 | 0.0 | 0.0 | 100.0 | 0.0 | 0.0 | 99.9 | 0.0 | 2.5 | 100.0 | 100.0 | 0.0 | 0.0 | 0.0 | 99.9 | 100.0 | 100.0 | 0.0 | |
| T | 0.0 | 0.0 | 0.0 | 100.0 | 100.0 | 0.0 | 62.9 | 0.1 | 0.1 | 0.1 | 0.0 | 0.0 | 0.0 | 0.0 | 0.0 | 0.0 | 0.0 | 0.0 | 0.0 | 0.0 | |
| # reads | 109197 | 108462 | 109672 | 107944 | 106792 | 107689 | 106651 | 106664 | 106831 | 107685 | 110158 | 109600 | 109201 | 106892 | 107659 | 112215 | 110543 | 110578 | 110632 | 110159 | |

ABE7.9

| Site 6 | G1 | G2 | A3 | T4 | T5 | G6 | A7 | C8 | C9 | C10 | A11 | G12 | G13 | C14 | C15 | A16 | G17 | G18 | G19 | C20 | Indel% |
|---|---|---|---|---|---|---|---|---|---|---|---|---|---|---|---|---|---|---|---|---|---|
| A | 0.0 | 0.0 | 98.6 | 0.0 | 0.0 | 0.0 | 36.5 | 0.1 | 0.0 | 0.0 | 99.8 | 0.1 | 0.0 | 0.0 | 0.0 | 100.0 | 0.1 | 0.0 | 0.0 | 0.0 | 0.03 |
| C | 0.0 | 0.0 | 0.0 | 0.0 | 0.0 | 0.0 | 0.0 | 99.9 | 0.0 | 100.0 | 0.0 | 0.0 | 0.0 | 100.0 | 99.9 | 0.0 | 0.0 | 0.0 | 0.0 | 99.9 | |
| G | 100.0 | 100.0 | 1.4 | 0.0 | 0.0 | 100.0 | 0.0 | 0.0 | 100.0 | 0.0 | 0.2 | 99.9 | 100.0 | 0.0 | 0.0 | 0.0 | 99.9 | 100.0 | 100.0 | 0.0 | |
| T | 0.0 | 0.0 | 0.0 | 100.0 | 100.0 | 0.0 | 63.5 | 0.0 | 0.0 | 0.0 | 0.0 | 0.0 | 0.0 | 0.0 | 0.0 | 0.0 | 0.0 | 0.0 | 0.0 | 0.0 | |
| # reads | 35765 | 36170 | 36173 | 35676 | 35063 | 34896 | 34618 | 35049 | 34816 | 34947 | 35851 | 35296 | 35300 | 34890 | 34866 | 35991 | 35617 | 35538 | 35651 | 35591 | |

Untreated HBG1 (Indel% 0.12)

| HBG1 | G₁ | T₂ | G₃ | G₄ | G₅ | G₆ | A₇ | A₈ | G₉ | G₁₀ | G₁₁ | G₁₂ | C₁₃ | C₁₄ | C₁₅ | C₁₆ | C₁₇ | A₁₈ | A₁₉ | G₂₀ | A | G | G |
|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 100.0 | 100.0 | 0.0 | 0.0 | 0.0 | 0.0 | 0.0 | 0.0 | 0.0 | 0.0 | 0.0 | 100.0 | 100.0 | 0.1 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 100.0 | 100.0 | 100.0 | 100.0 | 100.0 | 0.0 | 0.0 | 0.0 | 0.0 | 0.0 | 0.0 |
| G | 99.6 | 0.2 | 100.0 | 99.9 | 100.0 | 100.0 | 0.0 | 0.0 | 100.0 | 100.0 | 100.0 | 100.0 | 0.0 | 0.0 | 0.0 | 0.0 | 0.0 | 0.0 | 0.0 | 100.0 | 0.0 | 100.0 | 100.0 |
| T | 0.4 | 99.8 | 0.0 | 0.0 | 0.0 | 0.0 | 0.0 | 0.1 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |

ABE7.10 HBG1 (Indel% 1.2)

| HBG1 | G₁ | T₂ | G₃ | G₄ | G₅ | G₆ | A₇ | A₈ | G₉ | G₁₀ | G₁₁ | G₁₂ | C₁₃ | C₁₄ | C₁₅ | C₁₆ | C₁₇ | A₁₈ | A₁₉ | G₂₀ | A | G | G |
|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 70.6 | 96.6 | 0.1 | 0.0 | 0.0 | 0.0 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 99.9 | 100.0 | 100.0 | 100.0 | 100.0 | 0.0 | 0.0 | 0.0 | 0.0 | 0.0 | 0.0 |
| G | 99.6 | 0.2 | 100.0 | 100.0 | 99.9 | 100.0 | 29.4 | 3.4 | 99.9 | 100.0 | 100.0 | 100.0 | 0.0 | 0.0 | 0.0 | 0.0 | 0.0 | 0.0 | 0.0 | 100.0 | 0.0 | 100.0 | 100.0 |
| T | 0.4 | 99.8 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |

Untreated HBG2 (Indel% 0.15)

| HBG2 | G₁ | T₂ | G₃ | G₄ | G₅ | G₆ | A₇ | A₈ | G₉ | G₁₀ | G₁₁ | G₁₂ | C₁₃ | C₁₄ | C₁₅ | C₁₆ | C₁₇ | A₁₈ | A₁₉ | G₂₀ | A | G | G |
|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 100.0 | 100.0 | 0.0 | 0.0 | 0.0 | 0.0 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 100.0 | 100.0 | 100.0 | 100.0 | 100.0 | 0.0 | 0.0 | 0.0 | 0.0 | 0.0 | 0.0 |
| G | 99.6 | 0.1 | 100.0 | 100.0 | 100.0 | 100.0 | 0.0 | 0.0 | 100.0 | 100.0 | 100.0 | 100.0 | 0.0 | 0.0 | 0.0 | 0.0 | 0.0 | 0.0 | 0.0 | 100.0 | 0.0 | 100.0 | 100.0 |
| T | 0.4 | 99.9 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |

AEB7.10 HBG2 (Indel% 1.4)

| HBG2 | G₁ | T₂ | G₃ | G₄ | G₅ | G₆ | A₇ | A₈ | G₉ | G₁₀ | G₁₁ | G₁₂ | C₁₃ | C₁₄ | C₁₅ | C₁₆ | C₁₇ | A₁₈ | A₁₉ | G₂₀ | A | G | G |
|---|---|---|---|---|---|---|---|---|---|---|---|---|---|---|---|---|---|---|---|---|---|---|---|
| A | 0.0 | 0.0 | 0.0 | 0.0 | 0.0 | 0.0 | 69.9 | 96.7 | 0.1 | 0.0 | 0.0 | 0.0 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.1 | 0.0 | 0.0 | 0.0 | 0.0 | 0.0 | 0.0 | 0.0 | 100.0 | 100.0 | 100.0 | 99.9 | 99.9 | 0.0 | 0.0 | 0.0 | 0.0 | 0.0 | 0.0 |
| G | 99.6 | 0.1 | 100.0 | 100.0 | 99.9 | 100.0 | 30.1 | 3.3 | 100.0 | 100.0 | 100.0 | 100.0 | 0.0 | 0.0 | 0.0 | 0.1 | 0.0 | 0.0 | 0.0 | 100.0 | 0.0 | 100.0 | 100.0 |
| T | 0.4 | 99.9 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |

Untreated HFE C282Y

| | Tyr | | Thr | | | Tyr | | | | Gln | | Val | | | | Glu | | His | | Pro | | | indel% |
|---|---|---|---|---|---|---|---|---|---|---|---|---|---|---|---|---|---|---|---|---|---|---|---|
| HFE C282Y | T | A | A₁ | C₂ | G₃ | T₄ | A₅ | C₆ | C₇ | A₈ | G₉ | G₁₀ | T₁₁ | G₁₂ | G₁₃ | A₁₄ | G₁₅ | C₁₆ | A₁₇ | C₁₈ | C₁₉ | C₂₀ | A | G | G | 0.027 |
| A | 0.0 | 100.0 | 100.0 | 0.0 | 0.0 | 0.0 | 100.0 | 0.0 | 0.0 | 100.0 | 0.0 | 0.0 | 0.0 | 0.0 | 0.0 | 100.0 | 0.0 | 0.0 | 100.0 | 0.0 | 0.0 | 0.0 | 100.0 | 0.0 | 0.0 | |
| C | 0.0 | 0.0 | 0.0 | 100.0 | 0.0 | 0.0 | 0.0 | 100.0 | 100.0 | 0.0 | 0.0 | 0.0 | 0.0 | 0.0 | 0.0 | 0.0 | 0.0 | 100.0 | 0.0 | 100.0 | 100.0 | 100.0 | 0.0 | 0.0 | 0.0 | |
| G | 0.0 | 0.0 | 0.0 | 0.0 | 99.9 | 0.0 | 0.0 | 0.0 | 0.0 | 0.0 | 100.0 | 100.0 | 0.0 | 100.0 | 99.9 | 0.0 | 100.0 | 0.0 | 0.0 | 0.0 | 0.0 | 0.0 | 0.0 | 100.0 | 100.0 | |
| T | 100.0 | 0.0 | 0.0 | 0.0 | 0.0 | 100.0 | 0.0 | 0.0 | 0.0 | 0.0 | 0.0 | 0.0 | 100.0 | 0.0 | 0.0 | 0.0 | 0.0 | 0.0 | 0.0 | 0.0 | 0.0 | 0.0 | 0.0 | 0.0 | 0.0 | |

ABE7.10 HFE C282Y

| | Tyr | | Thr | | | Tyr → Cys | | | | Gln | | Val | | | | Glu | | His | | Pro | | | indel% |
|---|---|---|---|---|---|---|---|---|---|---|---|---|---|---|---|---|---|---|---|---|---|---|---|
| HFE C282Y | T | A | A₁ | C₂ | G₃ | T₄ | A₅ | C₆ | C₇ | A₈ | G₉ | G₁₀ | T₁₁ | G₁₂ | G₁₃ | A₁₄ | G₁₅ | C₁₆ | A₁₇ | C₁₈ | C₁₉ | C₂₀ | A | G | G | 0.028 |
| A | 0.0 | 100.0 | 100.0 | 0.0 | 0.0 | 0.0 | 71.6 | 0.0 | 0.0 | 100.0 | 99.9 | 0.0 | 0.0 | 0.0 | 0.0 | 100.0 | 0.0 | 0.0 | 100.0 | 0.0 | 0.0 | 0.0 | 100.0 | 0.0 | 0.0 | |
| C | 0.0 | 0.0 | 0.0 | 100.0 | 0.0 | 0.0 | 28.4 | 100.0 | 100.0 | 0.0 | 0.0 | 0.0 | 0.0 | 0.0 | 0.0 | 0.0 | 0.0 | 100.0 | 0.0 | 100.0 | 100.0 | 100.0 | 0.0 | 0.0 | 0.0 | |
| G | 0.0 | 0.0 | 0.0 | 0.0 | 100.0 | 0.0 | 0.0 | 0.0 | 0.0 | 0.0 | 0.0 | 100.0 | 0.0 | 100.0 | 100.0 | 0.0 | 100.0 | 0.0 | 0.0 | 0.0 | 0.0 | 0.0 | 0.0 | 100.0 | 100.0 | |
| T | 100.0 | 0.0 | 0.0 | 0.0 | 0.0 | 100.0 | 0.0 | 0.0 | 0.0 | 0.0 | 0.0 | 0.0 | 100.0 | 0.0 | 0.0 | 0.0 | 0.0 | 0.0 | 0.0 | 0.0 | 0.0 | 0.0 | 0.0 | 0.0 | 0.0 | |

FIG. 6C (cont'd)

| | 23 | 26 | 36 | 37 | 48 | 49 | 51 | 72 | 84 | 97 | 106 | 108 | 123 | 125 | 142 | 146 | 147 | 152 | 155 | 156 | 157 | 161 | TadA state | linker 1 length | linker 2 length | other modifications relative to TadA*–Cas9 nickase |
|---|---|---|---|---|---|---|---|---|---|---|---|---|---|---|---|---|---|---|---|---|---|---|---|---|---|---|
| ABE0.1 | W | R | H | N | P | I | R | N | L | S | A | D | H | G | A | S | D | R | E | I | K | K | monomer | | 16 | wTadA—Cas9 nickase |
| ABE0.2 | W | R | H | N | P | I | R | N | L | S | A | D | H | G | A | S | D | R | E | I | K | K | homodimer | 32 | 32 | wTadA—wTadA—Cas9 nickase |
| ABE1.1 | W | R | H | N | P | I | R | N | L | S | A | D | H | G | A | S | D | R | E | I | K | K | monomer | | 16 | |
| ABE1.2 | W | R | H | N | P | I | R | N | L | S | A | D | H | G | A | S | D | R | E | I | K | K | monomer | | 16 | |
| ABE2.1 | W | R | H | N | P | I | R | N | L | S | V | N | H | G | A | S | D | R | E | I | K | K | monomer | | 16 | |
| ABE2.2 | W | R | H | N | P | I | R | N | L | S | V | N | H | G | A | S | Y | R | V | I | K | K | monomer | | 16 | C-terminal dAAG(E125Q) |
| ABE2.3 | W | R | H | N | P | I | R | N | L | S | V | N | H | G | A | S | Y | R | V | I | K | K | monomer | | 16 | C-terminal dEndoV(D35A) |
| ABE2.4 | W | R | H | N | P | I | R | N | L | S | V | N | H | G | A | S | Y | R | V | I | K | K | monomer | | 16 | TadA2.1 at C-terminus of Cas9 nickase |
| ABE2.5 | W | R | H | N | P | I | R | N | L | S | V | N | H | G | A | S | Y | R | V | I | K | K | monomer | | 16 | |
| ABE2.6 | W | R | H | N | P | I | R | N | L | S | V | N | H | G | A | S | Y | R | V | I | K | K | monomer | | 3 | |
| ABE2.7 | W | R | H | N | P | I | R | N | L | S | V | N | H | G | A | S | Y | R | V | I | K | K | heterodimer | | 32 | overexpression of wt TadA |
| ABE2.8 | W | R | H | N | P | I | R | N | L | S | V | N | H | G | A | S | Y | R | V | I | K | K | homodimer | 32 | 16 | overexpression of TadA2.1 |
| ABE2.9 | W | R | H | N | P | I | R | N | L | S | V | N | H | G | A | S | Y | R | V | I | K | K | heterodimer | 32 | 16 | TadA2.1—TadA2.1—Cas9 nickase |
| ABE2.10 | W | R | H | N | P | I | R | N | L | S | V | N | H | G | A | S | Y | R | V | I | K | K | heterodimer | 32 | 16 | wTadA—TadA2.1—Cas9 nickase |
| ABE2.11 | W | R | H | N | P | I | R | N | L | S | V | N | H | G | A | S | Y | R | V | I | K | K | heterodimer | 32 | 16 | dTadA2.1(E59A)—TadA2.1—Cas9 nickase |
| ABE2.12 | W | R | H | N | P | I | R | N | L | S | V | N | H | G | A | S | Y | R | V | I | K | K | heterodimer | 32 | 16 | TadA2.1—dTadA2.1(E59A)—Cas9 nickase |
| ABE3.1 | W | R | H | N | P | I | R | N | F | S | V | N | Y | G | A | S | Y | R | V | F | K | K | homodimer | 32 | 32 | |
| ABE3.2 | W | R | H | N | P | I | R | N | F | S | V | N | Y | G | A | S | Y | R | V | F | K | K | heterodimer | 32 | 32 | |
| ABE3.3 | W | R | H | N | P | I | R | N | F | S | V | N | Y | G | A | S | Y | R | V | F | K | K | heterodimer | 100 | 32 | |

| | 23 | 26 | 36 | 37 | 48 | 49 | 51 | 72 | 84 | 97 | 106 | 108 | 123 | 125 | 142 | 146 | 147 | 152 | 155 | 156 | 157 | 161 | TadA state | linker 1 length | linker 2 length | other modifications relative to TadA*-Cas9 nickase |
|---|---|---|---|---|---|---|---|---|---|---|---|---|---|---|---|---|---|---|---|---|---|---|---|---|---|---|
| ABE3.4 | W | R | H | N | P | I | R | N | F | S | V | N | Y | G | A | S | Y | R | V | F | K | K | homodimer | 100 | 32 | |
| ABE3.5 | W | R | H | N | P | I | R | N | F | S | V | N | Y | G | A | S | Y | R | V | F | K | K | heterodimer | 100 | 64 | |
| ABE3.6 | W | R | H | N | P | I | R | N | F | S | V | N | Y | G | A | S | Y | R | V | F | K | K | homodimer | 100 | 64 | |
| ABE3.7 | W | R | H | N | P | I | R | N | F | S | V | N | Y | G | A | S | Y | R | V | F | K | K | heterodimer | 32 | 64 | |
| ABE3.8 | W | R | H | N | P | I | R | N | F | S | V | N | Y | G | A | S | Y | R | V | F | K | K | homodimer | 32 | 64 | |
| ABE4.1 | W | G | H | N | P | I | R | N | L | S | V | N | H | G | N | S | Y | R | V | — | — | K | homodimer | 32 | 32 | |
| ABE4.2 | W | R | H | N | P | I | R | N | L | S | V | N | H | G | N | S | Y | R | V | — | — | K | heterodimer | 32 | 32 | |
| ABE4.3 | W | R | H | N | P | I | R | N | F | S | V | N | Y | G | A | S | Y | R | V | F | K | K | homodimer | 32 | 32 | |
| ABE5.1 | W | R | L | S | P | I | L | N | F | S | V | N | Y | G | A | C | Y | R | V | F | N | T | homodimer | 32 | 32 | |
| ABE5.2 | W | R | H | N | P | I | R | N | F | S | V | N | Y | G | A | S | Y | R | V | F | K | T | heterodimer | 32 | 32 | |
| ABE5.3 | W | R | L | S | P | I | L | N | F | S | V | N | Y | G | A | C | Y | R | V | F | N | K | heterodimer | 32 | 32 | |
| ABE5.4 | W | R | H | N | P | I | R | N | F | S | V | N | Y | G | A | S | Y | R | V | F | K | T | heterodimer | 32 | 32 | |
| ABE5.5 | W | R | L | N | P | I | L | N | F | S | V | N | Y | G | A | C | Y | R | V | F | N | K | heterodimer | 24 | 24 | |
| ABE5.6 | W | R | L | N | P | I | L | N | F | S | V | N | Y | G | A | C | Y | R | V | F | N | K | heterodimer | 24 | 32 | |
| ABE5.7 | W | R | L | N | P | I | L | N | F | S | V | N | Y | G | A | C | Y | R | V | F | N | K | heterodimer | 24 | 24 | |
| ABE5.8 | W | R | L | N | P | I | L | N | F | S | V | N | Y | G | A | C | Y | R | V | F | N | K | heterodimer | 32 | 40 | |
| ABE5.9 | W | R | L | N | P | I | L | N | F | S | V | N | Y | G | A | C | Y | R | V | F | N | K | heterodimer | 32 | 24 | |
| ABE5.10 | W | R | L | N | P | I | L | N | F | S | V | N | Y | G | A | C | Y | R | V | F | N | K | heterodimer | 40 | 40 | |
| ABE5.11 | W | R | L | N | P | I | L | N | F | S | V | N | Y | G | A | C | Y | R | V | F | N | K | heterodimer | 40 | 32 | |

FIG. 7 (cont'd)

| | 23 | 26 | 36 | 37 | 48 | 49 | 51 | 72 | 84 | 97 | 106 | 108 | 123 | 125 | 142 | 146 | 147 | 152 | 155 | 156 | 157 | 161 | TadA state | linker 1 length | linker 2 length | other modifications relative to TadA*-Cas9 nickase |
|---|---|---|---|---|---|---|---|---|---|---|---|---|---|---|---|---|---|---|---|---|---|---|---|---|---|---|
| ABE5.12 | W | R | L | N | P | I | – | N | F | S | V | N | Y | G | A | C | Y | R | V | F | N | K | heterodimer | 40 | 40 | |
| ABE5.13 | W | R | H | N | P | – | D | F | S | V | N | Y | A | S | Y | R | V | F | K | | | | homodimer | 32 | 32 | |
| ABE5.14 | W | R | H | N | – | – | L | N | F | S | V | N | Y | G | A | S | Y | R | V | F | K | | homodimer | 32 | 32 | |
| ABE6.1 | W | R | H | N | S | – | L | N | F | S | V | N | Y | G | N | S | Y | R | V | F | N | K | heterodimer | 32 | 32 | |
| ABE6.2 | W | R | H | N | S | I | L | N | F | S | V | N | Y | G | N | S | Y | R | V | F | N | K | heterodimer | 32 | 32 | |
| ABE6.3 | W | R | H | N | T | V | L | N | F | S | V | N | Y | G | A | C | Y | R | V | – | N | K | heterodimer | 32 | 32 | |
| ABE6.4 | W | R | H | N | S | – | L | N | F | S | V | N | Y | G | N | C | Y | R | V | – | N | K | heterodimer | 32 | 32 | |
| ABE6.5 | W | R | H | N | S | V | L | N | F | S | V | N | Y | G | A | C | Y | R | V | F | N | K | heterodimer | 32 | 32 | |
| ABE6.6 | W | R | H | N | T | – | L | N | F | S | V | N | Y | G | N | C | Y | R | V | F | N | K | heterodimer | 32 | 32 | |
| ABE7.1 | W | R | L | N | A | – | L | N | F | S | V | N | Y | G | A | C | Y | R | V | F | N | K | heterodimer | 32 | 32 | |
| ABE7.2 | L | R | L | N | A | – | L | N | F | S | V | N | Y | G | A | C | Y | R | V | F | N | K | heterodimer | 32 | 32 | |
| ABE7.3 | W | R | L | N | A | – | L | N | F | S | V | N | Y | G | A | C | Y | H | V | F | N | K | heterodimer | 32 | 32 | |
| ABE7.4 | W | R | L | N | A | – | L | N | F | S | V | N | Y | G | A | C | Y | P | V | F | N | K | heterodimer | 32 | 32 | |
| ABE7.5 | W | R | L | N | A | – | L | N | F | S | V | N | Y | G | A | C | Y | R | V | F | N | K | heterodimer | 32 | 32 | |
| ABE7.6 | W | R | L | N | A | – | L | N | F | S | V | N | Y | G | A | C | Y | P | V | F | N | K | heterodimer | 32 | 32 | |
| ABE7.7 | L | R | L | N | A | – | L | N | F | S | V | N | Y | G | N | C | Y | R | V | F | N | K | heterodimer | 32 | 32 | |
| ABE7.8 | L | R | L | N | A | – | L | N | F | S | V | N | Y | G | A | C | Y | R | V | F | N | K | heterodimer | 32 | 32 | |
| ABE7.9 | L | R | L | N | A | – | L | N | F | S | V | N | Y | G | A | C | Y | R | V | F | N | K | heterodimer | 32 | 32 | |
| ABE7.10 | R | R | L | N | A | – | L | N | F | S | V | N | Y | G | A | C | Y | R | V | F | N | K | heterodimer | 32 | 32 | |

| | ecTadA-Cas9 nickase (ABE0.1) | hADAR-Cas9 nickase | mADA-Cas9 nickase | hADAR2-Cas9 nickase | Untreated cells |
|---|---|---|---|---|---|
| Site 1 | 0.21±0.073% | 0.14±0.18% | 0.080±0.092% | 0.080±0.075% | 0.17±0.052% |
| Site 2 | 0.084±0.035% | 0.059±0.017% | 0.067±0.012% | 0.040±0.025% | 0.062±0.068% |
| Site 3 | 0.096±0.045% | 0.023±0.012% | 0.023±0.011% | 0.023±0.010% | 0.051±0.052% |
| Site 4 | 0.034±0.022% | 0.029±0.021% | 0.028±0.019% | 0.029±0.013% | 0.026±0.010% |
| Site 5 | 0.027±0.015% | 0.022±0.008% | 0.065±0.057% | 0.024±0.016% | 0.034±0.015% |
| Site 6 | 0.045±0.020% | 0.18±0.29% | 0.065±0.094% | 0.020±0.006% | 0.028±0.025% |

| Untreated Site 5 | G₁ | A₂ | T₃ | G₄ | A₅ | G₆ | A₇ | T₈ | A₉ | A₁₀ | T₁₁ | G₁₂ | A₁₃ | T₁₄ | G₁₅ | A₁₆ | G₁₇ | T₁₈ | C₁₉ | A₂₀ | G | G | G | Indel% |
|---|---|---|---|---|---|---|---|---|---|---|---|---|---|---|---|---|---|---|---|---|---|---|---|---|
| A | 0.0 | 99.9 | 0.0 | 0.1 | 99.9 | 0.0 | 99.9 | 0.0 | 100.0 | 100.0 | 0.0 | 0.1 | 100.0 | 0.0 | 0.1 | 100.0 | 0.0 | 0.0 | 0.0 | 100.0 | 0.0 | 0.0 | 0.0 | 0.036 |
| C | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 99.9 | 0.0 | 0.0 | 0.0 | 0.0 | |
| G | 0.0 | 0.0 | 0.0 | 99.9 | 0.0 | 100.0 | 0.0 | 0.0 | 0.0 | 0.0 | 0.0 | 99.9 | 0.0 | 0.0 | 99.9 | 0.0 | 100.0 | 0.0 | 0.0 | 0.0 | 100.0 | 100.0 | 0.0 | |
| T | 100.0 | 0.0 | 100.0 | 0.0 | 0.0 | 0.0 | 0.0 | 100.0 | 0.0 | 0.0 | 100.0 | 0.0 | 0.0 | 100.0 | 0.0 | 0.0 | 0.0 | 100.0 | 0.0 | 0.0 | 0.0 | 0.0 | 100.0 | |

| ABE2.1 Site 5 | G₁ | A₂ | T₃ | G₄ | A₅ | G₆ | A₇ | T₈ | A₉ | A₁₀ | T₁₁ | G₁₂ | A₁₃ | T₁₄ | G₁₅ | A₁₆ | G₁₇ | T₁₈ | C₁₉ | A₂₀ | G | G | G | Indel% |
|---|---|---|---|---|---|---|---|---|---|---|---|---|---|---|---|---|---|---|---|---|---|---|---|---|
| A | 0.0 | 100.0 | 0.0 | 0.1 | 93.0 | 0.0 | 94.8 | 0.0 | 99.9 | 100.0 | 0.0 | 0.1 | 100.0 | 0.0 | 0.1 | 100.0 | 0.0 | 0.0 | 0.0 | 100.0 | 0.0 | 0.0 | 0.0 | 0.060 |
| C | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 100.0 | 0.0 | 0.0 | 0.0 | 0.0 | |
| G | 99.9 | 0.0 | 0.0 | 99.9 | 7.0 | 100.0 | 5.2 | 0.0 | 0.1 | 0.0 | 0.0 | 99.8 | 0.0 | 0.0 | 99.8 | 0.0 | 100.0 | 0.0 | 0.0 | 0.0 | 100.0 | 100.0 | 0.0 | |
| T | 0.0 | 0.0 | 100.0 | 0.0 | 0.0 | 0.0 | 0.0 | 100.0 | 0.0 | 0.0 | 100.0 | 0.1 | 0.0 | 100.0 | 0.1 | 0.0 | 0.0 | 100.0 | 0.0 | 0.0 | 0.0 | 0.0 | 100.0 | |

| Untreated Site 6 | G₁ | G₂ | A₃ | T₄ | T₅ | G₆ | A₇ | C₈ | C₉ | C₁₀ | A₁₁ | G₁₂ | G₁₃ | C₁₄ | C₁₅ | A₁₆ | G₁₇ | G₁₈ | G₁₉ | C₂₀ | T | G | G | Indel% |
|---|---|---|---|---|---|---|---|---|---|---|---|---|---|---|---|---|---|---|---|---|---|---|---|---|
| A | 0.0 | 0.1 | 100.0 | 0.0 | 0.0 | 0.0 | 100.0 | 0.0 | 0.0 | 0.0 | 100.0 | 0.0 | 0.0 | 0.0 | 0.0 | 100.0 | 0.0 | 0.0 | 0.0 | 100.0 | 0.0 | 0.0 | 0.0 | 0.014 |
| C | 0.0 | 0.0 | 0.0 | 0.0 | 0.0 | 0.0 | 0.0 | 99.9 | 100.0 | 99.9 | 0.0 | 0.0 | 0.0 | 100.0 | 100.0 | 0.0 | 0.0 | 0.0 | 0.0 | 0.0 | 0.0 | 0.0 | 0.0 | |
| G | 99.9 | 99.8 | 0.0 | 0.0 | 0.0 | 99.9 | 0.0 | 0.0 | 0.0 | 0.0 | 0.0 | 100.0 | 100.0 | 0.0 | 0.0 | 0.0 | 100.0 | 100.0 | 99.9 | 0.0 | 0.0 | 100.0 | 100.0 | |
| T | 0.0 | 0.0 | 0.0 | 100.0 | 100.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 100.0 | 0.0 | 0.0 | |

| ABE2.1 Site 6 | G₁ | G₂ | A₃ | T₄ | T₅ | G₆ | A₇ | C₈ | C₉ | C₁₀ | A₁₁ | G₁₂ | G₁₃ | C₁₄ | C₁₅ | A₁₆ | G₁₇ | G₁₈ | G₁₉ | C₂₀ | T | G | G | Indel% |
|---|---|---|---|---|---|---|---|---|---|---|---|---|---|---|---|---|---|---|---|---|---|---|---|---|
| A | 0.0 | 0.1 | 99.9 | 0.0 | 0.0 | 0.0 | 87.1 | 0.1 | 0.0 | 0.0 | 100.0 | 0.0 | 0.0 | 0.0 | 0.0 | 100.0 | 0.1 | 0.0 | 0.0 | 99.9 | 0.0 | 0.0 | 0.0 | 0.014 |
| C | 0.0 | 0.0 | 0.0 | 0.0 | 0.0 | 0.0 | 0.0 | 99.9 | 99.9 | 99.9 | 0.0 | 0.0 | 0.0 | 99.9 | 99.9 | 0.0 | 0.0 | 0.0 | 0.0 | 0.0 | 0.0 | 0.0 | 0.0 | |
| G | 100.0 | 99.9 | 0.0 | 0.0 | 0.0 | 100.0 | 12.9 | 0.0 | 0.1 | 0.1 | 0.0 | 100.0 | 100.0 | 0.0 | 0.1 | 0.0 | 99.9 | 99.9 | 99.9 | 0.0 | 0.0 | 100.0 | 100.0 | |
| T | 0.0 | 0.1 | 0.1 | 100.0 | 100.0 | 0.0 | 0.0 | 0.1 | 0.0 | 0.0 | 0.0 | 0.0 | 0.0 | 0.1 | 0.1 | 0.0 | 0.1 | 0.1 | 0.1 | 0.1 | 100.0 | 0.0 | 0.0 | |

ABE7.8

| HBG1 | G1 | T2 | G3 | G4 | G5 | G6 | A7 | A8 | G9 | G10 | G11 | G12 | C13 | C14 | C15 | C16 | C17 | A18 | A19 | G20 | A | G | G | Indel% |
|---|---|---|---|---|---|---|---|---|---|---|---|---|---|---|---|---|---|---|---|---|---|---|---|---|
| A | 0.0 | 0.0 | 0.0 | 0.1 | 0.0 | 0.0 | 89.1 | 97.7 | 0.0 | 0.0 | 0.0 | 0.0 | 0.0 | 0.0 | 0.0 | 0.0 | 0.0 | 100.0 | 100.0 | 0.0 | 100.0 | 0.0 | 0.0 | 0.53 |
| C | 0.0 | 0.0 | 0.0 | 0.0 | 0.0 | 0.0 | 0.0 | 0.0 | 0.0 | 0.0 | 0.0 | 0.0 | 100.0 | 100.0 | 100.0 | 100.0 | 100.0 | 0.0 | 0.0 | 0.0 | 0.0 | 0.0 | 0.0 | |
| G | 99.5 | 0.2 | 100.0 | 99.9 | 100.0 | 100.0 | 10.8 | 2.3 | 100.0 | 100.0 | 100.0 | 100.0 | 0.0 | 0.0 | 0.0 | 0.0 | 0.0 | 0.0 | 0.0 | 100.0 | 0.0 | 100.0 | 100.0 | |
| T | 0.5 | 99.8 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | |

ABE7.9

| HBG1 | G1 | T2 | G3 | G4 | G5 | G6 | A7 | A8 | G9 | G10 | G11 | G12 | C13 | C14 | C15 | C16 | C17 | A18 | A19 | G20 | A | G | G | Indel% |
|---|---|---|---|---|---|---|---|---|---|---|---|---|---|---|---|---|---|---|---|---|---|---|---|---|
| A | 0.0 | 0.0 | 0.0 | 0.0 | 0.1 | 0.0 | 82.6 | 95.8 | 0.0 | 0.0 | 0.0 | 0.0 | 0.0 | 0.1 | 0.1 | 0.1 | 0.0 | 100.0 | 100.0 | 0.0 | 100.0 | 0.0 | 0.0 | 1.1 |
| C | 0.0 | 0.0 | 0.0 | 0.0 | 0.0 | 0.0 | 0.0 | 0.0 | 0.0 | 0.0 | 0.0 | 0.0 | 100.0 | 99.9 | 99.9 | 99.9 | 100.0 | 0.0 | 0.0 | 0.0 | 0.0 | 0.0 | 0.0 | |
| G | 99.5 | 0.1 | 100.0 | 100.0 | 99.9 | 100.0 | 17.4 | 4.2 | 100.0 | 100.0 | 100.0 | 100.0 | 0.0 | 0.0 | 0.0 | 0.0 | 0.0 | 0.0 | 0.0 | 100.0 | 0.0 | 100.0 | 100.0 | |
| T | 0.4 | 99.9 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | |

ABE7.10

| HBG1 | G1 | T2 | G3 | G4 | G5 | G6 | A7 | A8 | G9 | G10 | G11 | G12 | C13 | C14 | C15 | C16 | C17 | A18 | A19 | G20 | A | G | G | Indel% |
|---|---|---|---|---|---|---|---|---|---|---|---|---|---|---|---|---|---|---|---|---|---|---|---|---|
| A | 0.0 | 0.0 | 0.0 | 0.0 | 0.1 | 0.0 | 70.6 | 96.6 | 0.1 | 0.0 | 0.0 | 0.0 | 0.0 | 0.1 | 0.1 | 0.1 | 0.0 | 100.0 | 100.0 | 0.0 | 100.0 | 0.0 | 0.0 | 1.2 |
| C | 0.0 | 0.0 | 0.0 | 0.0 | 0.0 | 0.0 | 0.0 | 0.0 | 0.0 | 0.0 | 0.0 | 0.0 | 99.9 | 99.9 | 99.9 | 99.9 | 100.0 | 0.0 | 0.0 | 0.0 | 0.0 | 0.0 | 0.0 | |
| G | 99.6 | 0.2 | 100.0 | 100.0 | 99.9 | 100.0 | 29.4 | 3.4 | 99.9 | 100.0 | 100.0 | 100.0 | 0.0 | 0.0 | 0.0 | 0.0 | 0.0 | 0.0 | 0.0 | 100.0 | 0.0 | 100.0 | 100.0 | |
| T | 0.4 | 99.8 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | |

ABE7.8 — Indel% 0.56

| HBG2 | G1 | T2 | G3 | G4 | G5 | G6 | A7 | A8 | G9 | G10 | G11 | G12 | C13 | C14 | C15 | C16 | C17 | A18 | A19 | G20 | A | G | G |
|---|---|---|---|---|---|---|---|---|---|---|---|---|---|---|---|---|---|---|---|---|---|---|---|
| A | 0.0 | 0.0 | 0.0 | 0.1 | 0.1 | 0.0 | 69.2 | 97.8 | 0.0 | 0.0 | 0.0 | 0.1 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |
| G | 99.6 | 0.1 | 100.0 | 100.0 | 100.0 | 100.0 | 0.0 | 2.2 | 100.0 | 100.0 | 100.0 | 100.0 | 100.0 | 100.0 | 99.9 | 100.0 | 100.0 | 0.0 | 0.0 | 100.0 | 0.0 | 100.0 | 100.0 |
| T | 0.4 | 99.8 | 0.0 | 0.0 | 0.0 | 0.0 | 30.8 | 0.0 | 0.0 | 0.0 | 0.0 | 0.0 | 0.0 | 0.0 | 0.1 | 0.0 | 0.0 | 0.0 | 0.0 | 0.0 | 0.0 | 0.0 | 0.0 |

ABE7.9 — Indel% 1.2

| HBG2 | G1 | T2 | G3 | G4 | G5 | G6 | A7 | A8 | G9 | G10 | G11 | G12 | C13 | C14 | C15 | C16 | C17 | A18 | A19 | G20 | A | G | G |
|---|---|---|---|---|---|---|---|---|---|---|---|---|---|---|---|---|---|---|---|---|---|---|---|
| A | 0.1 | 0.0 | 0.0 | 0.0 | 0.1 | 0.0 | 82.9 | 96.1 | 0.0 | 0.0 | 0.0 | 0.0 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |
| G | 99.6 | 0.1 | 100.0 | 100.0 | 99.9 | 100.0 | 0.0 | 4.0 | 100.0 | 100.0 | 100.0 | 100.0 | 100.0 | 100.0 | 99.9 | 99.9 | 99.9 | 0.0 | 0.0 | 100.0 | 0.0 | 100.0 | 100.0 |
| T | 0.4 | 99.9 | 0.0 | 0.0 | 0.0 | 0.0 | 17.1 | 0.0 | 0.0 | 0.0 | 0.0 | 0.0 | 0.0 | 0.0 | 0.1 | 0.1 | 0.1 | 0.0 | 0.0 | 0.0 | 0.0 | 0.0 | 0.0 |

ABE7.10 — Indel% 1.4

| HBG2 | G1 | T2 | G3 | G4 | G5 | G6 | A7 | A8 | G9 | G10 | G11 | G12 | C13 | C14 | C15 | C16 | C17 | A18 | A19 | G20 | A | G | G |
|---|---|---|---|---|---|---|---|---|---|---|---|---|---|---|---|---|---|---|---|---|---|---|---|
| A | 0.0 | 0.0 | 0.0 | 0.0 | 0.1 | 0.0 | 69.9 | 96.7 | 0.1 | 0.0 | 0.0 | 0.0 | 0.0 | 0.0 | 0.0 | 0.0 | 0.0 | 100.0 | 100.0 | 0.0 | 100.0 | 0.0 | 0.0 |
| C | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 | 0.0 |
| G | 99.6 | 0.1 | 100.0 | 100.0 | 99.9 | 100.0 | 0.0 | 3.3 | 100.0 | 100.0 | 100.0 | 100.0 | 100.0 | 100.0 | 100.0 | 99.9 | 99.9 | 0.0 | 0.0 | 100.0 | 0.0 | 100.0 | 100.0 |
| T | 0.4 | 99.9 | 0.0 | 0.0 | 0.0 | 0.0 | 30.1 | 0.0 | 0.0 | 0.0 | 0.0 | 0.0 | 0.0 | 0.0 | 0.0 | 0.1 | 0.1 | 0.0 | 0.0 | 0.0 | 0.0 | 0.0 | 0.0 |

| primer | sequence |
|---|---|
| R-sgRNA | 5'-GGTGTTTCGTCCTTTCCACAAG-3' |
| F-site 1 | 5'-GAACACAAAGCATAGACTGCGTTTTAGAGCTAGAAATAGCAAGTTAAAATAAGGC-3' |
| F-site 2 | 5'-GAGTATGAGGCATAGACTGCGTTTTAGAGCTAGAAATAGCAAGTTAAAATAAGGC-3' |
| F-site 3 | 5'-GTCAAGAAAGCAGAGACTGCGTTTTAGAGCTAGAAATAGCAAGTTAAAATAAGGC-3' |
| F-site 4 | 5'-GAGCAAAGAGAATAGACTGTGTTTTAGAGCTAGAAATAGCAAGTTAAAATAAGGC-3' |
| F-site 5 | 5'-GATGAGATAATGATGAGTCAGTTTTAGAGCTAGAAATAGCAAGTTAAAATAAGGC-3' |
| F-site 6 | 5'-GGATTGACCCAGGCCAGGGCGTTTTAGAGCTAGAAATAGCAAGTTAAAATAAGGC-3' |
| F-site 7 | 5'-GAATACTAAGCATAGACTCCGTTTTAGAGCTAGAAATAGCAAGTTAAAATAAGGC-3' |
| F-site 8 | 5'-GTAAACAAAGCATAGACTGAGTTTTAGAGCTAGAAATAGCAAGTTAAAATAAGGC-3' |
| F-site 9 | 5'-GAAGACCAAGGATAGACTGCGTTTTAGAGCTAGAAATAGCAAGTTAAAATAAGGC-3' |
| F-site 10 | 5'-GAACATAAAGAATAGAATGAGTTTTAGAGCTAGAAATAGCAAGTTAAAATAAGGC-3' |
| F-site 11 | 5'-GGACAGGCAGCATAGACTGTGTTTTAGAGCTAGAAATAGCAAGTTAAAATAAGGC-3' |
| F-site 12 | 5'-GTAGAAAAAGTATAGACTGCGTTTTAGAGCTAGAAATAGCAAGTTAAAATAAGGC-3' |
| F-site 13 | 5'-GAAGATAGAGAATAGACTGCGTTTTAGAGCTAGAAATAGCAAGTTAAAATAAGGC-3' |
| F-site 14 | 5'-GGCTAAAGACCATAGACTGTGTTTTAGAGCTAGAAATAGCAAGTTAAAATAAGGC-3' |
| F-site 15 | 5'-GTCTAGAAAGCTTAGACTGCGTTTTAGAGCTAGAAATAGCAAGTTAAAATAAGGC-3' |
| F-site 16 | 5'-GGGAATAAATCATAGAATCCGTTTTAGAGCTAGAAATAGCAAGTTAAAATAAGGC-3' |
| F-site 17 | 5'-GACAAAGAGGAAGAGAGACGGTTTTAGAGCTAGAAATAGCAAGTTAAAATAAGGC-3' |
| F-site 18 | 5'-GACACACACTTAGAATCTGGTTTTAGAGCTAGAAATAGCAAGTTAAAATAAGGC-3' |
| F-site 19 | 5'-GCACACACTTAGAATCTGTGTTTTAGAGCTAGAAATAGCAAGTTAAAATAAGGC-3' |
| F-hbg1/2 | 5'-GTGGGGAAGGGGCCCCCAAGGTTTTAGAGCTAGAAATAGCAAGTTAAAATAAGGC-3' |
| F-HFE | 5'-GACGTACCAGGTGGAGCACCCGTTTTAGAGCTAGAAATAGCAAGTTAAAATAAGGC-3' |

FIG. 20

| primer | sequence |
|---|---|
| NMG-799 | AGTTGTACGCG/ideoxyU/CCAAAAAAACGGG |
| NMG-822 | AGATTAGCGGATCCTACCTGAC |
| NMG-823 | GCGGTCTGTATTTCCCAGAAC |
| NMG-824 | ACCGGGGACTTCAGAA/ideoxyU/CGGC |
| NMG-825 | ATTCTGAAGTCCCCGG/ideoxyU/GTTTCG |
| NMG-826 | ACGCGTACAAC/ideoxyU/CAAAGGAGGAAAAAAAAATG |
| NMG-1197 | ACGCTGGCGAAACG/ideoxyU/GCCTGGGATNNKNNKGAAGTGCCGGTCGGCGC |
| NMG-1198 | ACGTTTCGCCAGCG/ideoxyU/CAGCGCGTGACG |
| NMG-1199 | ACGCGAAAACTGGCGC/ideoxyU/GCG |
| NMG-1200 | AGCGCCAGTTTTCGCG/ideoxyU/TMNNCACACCAAAGACCACGCGACC |
| NMG-1201 | ACTGGCGGATGAG/ideoxyU/GCNNKNNKTTGCTCAGTTACTTCTTTCGCATGCG |
| NMG-1202 | ACTCATCCGCCAG/ideoxyU/ATTCCTTCCG |

FIG. 21

| evolution round | template used for mutagenesis | TadA mutations | gRNA 1 | gRNA 2 |
|---|---|---|---|---|
| 1 | pNMG-104 | wild-type | TACGGCGTAGTGCACCTGGA | n/a |
| 2 | pNMG-128 | H8Y, D108N, N127S | TACGGCGTAGTGCACCTGGA | n/a |
| 3 | pNMG-288 | A106V, D108N, D147Y, E155V | ATCTTATTCGATCATGCGAA | GCTTAGGTGGAGCGCCTATT |
| 4 | pNMG-343 | A106V, D108N, D147Y, E155V | CAATGATGACTTCTACAGCG | n/a |
| 5 | pNMG-381 | L84F, A106V, D108N, H123Y, D147Y, E155V, I156F. | CAATGATGACTTCTACAGCG | TACGGCGTAGTGCACCTGGA |
| 6 | round 1-5 plasmids + pNMG-104 | all mutations accumulated | CAATGATGACTTCTACAGCG | TACGGCGTAGTGCACCTGGA |
| 7 | multiple round 6 plasmids | H36L, P48S, L84F, S97C, A106V, D108N, H123Y, S146C, D147Y, E155V, I156F, K157N, K161T | TTCATTAACTGTGGCCGGCT | ATCTTATTCGATCATGCGAA |

FIG. 22

| evolution round | construct name | target antibiotic | target sequence | coding mutation | position of target A in protospacer | MIC in S1030 E. coli (μg/mL) |
|---|---|---|---|---|---|---|
| 1 | pNMG-110 | Cam$^R$ | TACGGCGTAGTGCACCTGGA | H193Y | 9 | 1 |
| 2 | pNMG-110 | Cam$^R$ | TACGGCGTAGTGCACCTGGA | H193Y | 9 | 1 |
| 3 | pNMG-319 | Kan$^R$ | ATCTTATTCGATCATGCGAA, GCTTAGGTGGAGCGCCTATT | Q4*, W15* | 6, 5 | 8 |
| 4 | pNMG-333 | Spect$^R$, Cam$^R$ | CAATGATGACTTCTACAGCG, TACGGCGTAGTGCACCTGGA | T89I (Spect) H193Y (Cam) | 6, 9 | 32 (spect only) 1 (chlor only) |
| 5 | pNMG-333 | Spect$^R$, Cam$^R$ | CAATGATGACTTCTACAGCG, TACGGCGTAGTGCACCTGGA | T89I (Spect) H193Y (Cam) | 6, 9 | 32 (spect only) 1 (chlor only) |
| 6 | pNMG-333 | Spect$^R$, Cam$^R$ | CAATGATGACTTCTACAGCG, TACGGCGTAGTGCACCTGGA | T89I (Spect) H193Y (Cam) | 6, 9 | 32 (spect only) 1 (chlor only) |
| 7 | pNMG-570 | Kan$^R$ | ATCTTATTCGATCATGCGAA, TTCATTAACTGTGGCCGGCT | Q4*, D208N. | 6, 7 | 8 |

FIG. 23

| primer name | sequence |
|---|---|
| fwd_site 1_HTS | ACACTCTTTCCCTACACGACGCTCTTCCGATCTNNNNCCAGCCCCATCTGTCAAACT |
| rev_site 1_HTS | TGGAGTTCAGACGTGTGCTCTTCCGATCTTGAATGGATTCCTTGGAAACAATGA |
| fwd_site 2_HTS | ACACTCTTTCCCTACACGACGCTCTTCCGATCTNNNNAGAGACTGATTGCGTGGAGT |
| rev_site 2_HTS | TGGAGTTCAGACGTGTGCTCTTCCGATCTCACTCCAGCCTAGGCAACAA |
| fwd_site 3_HTS | ACACTCTTTCCCTACACGACGCTCTTCCGATCTNNNNCCGACAGCCAGTGGTTAAGT |
| rev_site 3_HTS | TGGAGTTCAGACGTGTGCTCTTCCGATCTGCTTTTCACCGACTGCACAG |
| fwd_site 4_HTS | ACACTCTTTCCCTACACGACGCTCTTCCGATCTNNNNCTGCACCTAGCCTCCATGTC |
| rev_site 4_HTS | TGGAGTTCAGACGTGTGCTCTTCCGATCTCCTTGCACTGAGACCGTGAA |
| fwd_site 5_HTS | ACACTCTTTCCCTACACGACGCTCTTCCGATCTNNNNGTCTGAGGTCACACAGTGGG |
| rev_site 5_HTS | TGGAGTTCAGACGTGTGCTCTTCCGATCTCTGAGAGCAGGGACCACATC |
| fwd_site 6_HTS | ACACTCTTTCCCTACACGACGCTCTTCCGATCTNNNNATGTGGGCTGCCTAGAAAGG |
| rev_site 6_HTS | TGGAGTTCAGACGTGTGCTCTTCCGATCTCCAGCCAAACTTGTCAACC |
| fwd_site 7_HTS | ACACTCTTTCCCTACACGACGCTCTTCCGATCTNNNNGATCCCTCCATCTTCTCCG |
| rev_site 7_HTS | TGGAGTTCAGACGTGTGCTCTTCCGATCTAGGTTTGCATAGACCTGCCC |
| fwd_site 8_HTS | ACACTCTTTCCCTACACGACGCTCTTCCGATCTNNNNCCCTGTTCCTAAAGCCCACC |
| rev_site 8_HTS | TGGAGTTCAGACGTGTGCTCTTCCGATCTACTGGTTCTGTTTGTGGCCA |
| fwd_site 9_HTS | ACACTCTTTCCCTACACGACGCTCTTCCGATCTNNNNTTGCTTATTGCTGAGGGGCA |
| rev_site 9_HTS | TGGAGTTCAGACGTGTGCTCTTCCGATCTACCTCTCTCCTCAGCTGAG |
| fwd_site 10_HTS | ACACTCTTTCCCTACACGACGCTCTTCCGATCTNNNNTCCACCTCCCCACTTGTCTT |
| rev_site 10_HTS | TGGAGTTCAGACGTGTGCTCTTCCGATCTGGTGAAATGAGCAAGGCACA |
| fwd_site 11_HTS | ACACTCTTTCCCTACACGACGCTCTTCCGATCTNNNNCCCTAAACCACCTGCAGAGG |
| rev_site 11_HTS | TGGAGTTCAGACGTGTGCTCTTCCGATCTCAGCCCCAGCCACATTCTAT |
| fwd_site 12_HTS | ACACTCTTTCCCTACACGACGCTCTTCCGATCTNNNNACCCATGTGCCTGACATAGG |
| rev_site 12_HTS | TGGAGTTCAGACGTGTGCTCTTCCGATCTTGGTGATTATGGTTACACAGCG |
| fwd_site 13_HTS | ACACTCTTTCCCTACACGACGCTCTTCCGATCTNNNNTCACTTCAGCCCAGGAGTAT |
| rev_site 13_HTS | TGGAGTTCAGACGTGTGCTCTTCCGATCTTCTCTTTCTCTCCCCCACCC |
| fwd_site 14_HTS | ACACTCTTTCCCTACACGACGCTCTTCCGATCTNNNNGAACCTGAAGCCTTTCCCCA |
| rev_site 14_HTS | TGGAGTTCAGACGTGTGCTCTTCCGATCTAACCTGTGTGACACTTGGCA |
| fwd_site 15_HTS | ACACTCTTTCCCTACACGACGCTCTTCCGATCTNNNNGCAGACACCCACAACTGTCT |
| rev_site 15_HTS | TGGAGTTCAGACGTGTGCTCTTCCGATCTGCACTCAGCTAGACTTAACTCCC |
| fwd_site 16_HTS | ACACTCTTTCCCTACACGACGCTCTTCCGATCTNNNNGGGAGGTGGAGAGAGGATGT |
| rev_site 16_HTS | TGGAGTTCAGACGTGTGCTCTTCCGATCTTCCTGAGGTCTAGGAACCCG |
| fwd_site 17_HTS | ACACTCTTTCCCTACACGACGCTCTTCCGATCTNNNNCCCGGGCTGAAGTAGATCAA |
| rev_site 17_HTS | TGGAGTTCAGACGTGTGCTCTTCCGATCTGCTGTCTCTGCTCCTTTGTCCC |
| fwd_site 18/19_HTS | ACACTCTTTCCCTACACGACGCTCTTCCGATCTNNNNGCATTACCTGGGAGCCTGTT |
| rev_site 18/19_HTS | TGGAGTTCAGACGTGTGCTCTTCCGATCTAACTTCAGCGGGCATCAGAA |
| fwd_site HGB1/2_HTS | ACACTCTTTCCCTACACGACGCTCTTCCGATCTNNNNGTGGAGTTTAGCCAGGGACC |
| rev_site HGB1/2_HTS | TGGAGTTCAGACGTGTGCTCTTCCGATCTTACAGGCCTCACTGGAGCTA |
| fwd_site HFE_HTS | ACACTCTTTCCCTACACGACGCTCTTCCGATCTNNNNGGCTGGATAACCTTGGCTGT |
| rev_site HFE_HTS | TGGAGTTCAGACGTGTGCTCTTCCGATCTTCCTCAGGCACTCCTCTCAA |
| fwd_HEK2_HTS | ACACTCTTTCCCTACACGACGCTCTTCCGATCTNNNNCCAGCCCCATCTGTCAAACT |

FIG. 24

| Name | Sequence |
|---|---|
| rev_HEK2_HTS | TGGAGTTCAGACGTGTGCTCTTCCGATCTTGAATGGATTCCTTGGAAACAATGA |
| fwd_HEK3_HTS | ACACTCTTTCCCTACACGACGCTCTTCCGATCTNNNNATGTGGGCTGCCTAGAAAGG |
| rev_HEK3_HTS | TGGAGTTCAGACGTGTGCTCTTCCGATCTCCCAGCCAAACTTGTCAACC |
| fwd_HEK4_HTS | ACACTCTTTCCCTACACGACGCTCTTCCGATCTNNNNGAACCCAGGTAGCCAGAGAC |
| rev_HEK4_HTS | TGGAGTTCAGACGTGTGCTCTTCCGATCTCCTTTCAACCCGAACGGAG |
| fwd_HEK2_off1_HTS | ACACTCTTTCCCTACACGACGCTCTTCCGATCTNNNNGTGTGGAGAGTGAGTAAGCCA |
| rev_HEK2_off1_HTS | TGGAGTTCAGACGTGTGCTCTTCCGATCTACGGTAGGATGATTTCAGGCA |
| fwd_HEK2_off2_HTS | ACACTCTTTCCCTACACGACGCTCTTCCGATCTNNNNCACAAAGCAGTGTAGCTCAGG |
| rev_HEK2_off2_HTS | TGGAGTTCAGACGTGTGCTCTTCCGATCTTTTTTGGTACTCGAGTGTTATTCAG |
| fwd_HEK3_off1_HTS | ACACTCTTTCCCTACACGACGCTCTTCCGATCTNNNNTCCCCTGTTGACCTGGAGAA |
| rev_HEK3_off1_HTS | TGGAGTTCAGACGTGTGCTCTTCCGATCTCACTGTACTTGCCCTGACCA |
| fwd_HEK3_off2_HTS | ACACTCTTTCCCTACACGACGCTCTTCCGATCTNNNNTTGGTGTTGACAGGGAGCAA |
| rev_HEK3_off2_HTS | TGGAGTTCAGACGTGTGCTCTTCCGATCTCTGAGATGTGGGCAGAAGGG |
| fwd_HEK3_off3_HTS | ACACTCTTTCCCTACACGACGCTCTTCCGATCTNNNNTGAGAGGGAACAGAAGGGCT |
| rev_HEK3_off3_HTS | TGGAGTTCAGACGTGTGCTCTTCCGATCTGTCCAAAGGCCCAAGAACCT |
| fwd_HEK3_off4_HTS | ACACTCTTTCCCTACACGACGCTCTTCCGATCTNNNNTCCTAGCACTTTGGAAGGTCG |
| rev_HEK3_off4_HTS | TGGAGTTCAGACGTGTGCTCTTCCGATCTGCTCATCTTAATCTGCTCAGCC |
| fwd_HEK3_off5_HTS | ACACTCTTTCCCTACACGACGCTCTTCCGATCTNNNNAAAGGAGCAGCTCTTCCTGG |
| rev_HEK3_off5_HTS | TGGAGTTCAGACGTGTGCTCTTCCGATCTGTCTGCACCATCTCCCACAA |
| fwd_HEK4_off1_HTS | ACACTCTTTCCCTACACGACGCTCTTCCGATCTNNNNGGGCATGGCTTCTGAGACTCA |
| rev_HEK4_off1_HTS | TGGAGTTCAGACGTGTGCTCTTCCGATCTGTCTCCCTTGCACTCCCTGTCTTT |
| fwd_HEK4_off2_HTS | ACACTCTTTCCCTACACGACGCTCTTCCGATCTNNNNTTTGGCAATGGAGGCATTGG |
| rev_HEK4_off2_HTS | TGGAGTTCAGACGTGTGCTCTTCCGATCTGAAGAGGCTGCCCATGAGAG |
| fwd_HEK4_off3_HTS | ACACTCTTTCCCTACACGACGCTCTTCCGATCTNNNNGGTCTGAGGCTCGAATCCTG |
| rev_HEK4_off3_HTS | TGGAGTTCAGACGTGTGCTCTTCCGATCTCTGTGGCCCTCCATATCCCTG |
| fwd_HEK4_off4_HTS | ACACTCTTTCCCTACACGACGCTCTTCCGATCTNNNNTTTCCACCAGAACTCAGCCC |
| rev_HEK4_off4_HTS | TGGAGTTCAGACGTGTGCTCTTCCGATCTCCTCGGTTCCTCCACAACAC |
| fwd_HEK4_off5_HTS | ACACTCTTTCCCTACACGACGCTCTTCCGATCTNNNNCACGGGAAGGACAGGAGAAG |
| rev_HEK4_off5_HTS | TGGAGTTCAGACGTGTGCTCTTCCGATCTGCAGGGGAGGGATAAAGCAG |
| fwd_site_1_HDR_HTS | ACACTCTTTCCCTACACGACGCTCTTCCGATCTNNNNCCAGCCCCATCTGTCAAACT |
| rev_site_1_HDR_HTS | TGGAGTTCAGACGTGTGCTCTTCCGATCTTGAATGGATTCCTTGGAAACAATGA |
| fwd_site_2_HDR_HTS | ACACTCTTTCCCTACACGACGCTCTTCCGATCTNNNNCCCTGAGATACAGTCACGAGGT |
| rev_site_2_HDR_HTS | TGGAGTTCAGACGTGTGCTCTTCCGATCTCCTGAAATGCTGTGCGTGTCTA |
| fwd_site_3_HDR_HTS | ACACTCTTTCCCTACACGACGCTCTTCCGATCTNNNNGCCCACATTACCTTGGTGCATA |
| rev_site_3_HDR_HTS | TGGAGTTCAGACGTGTGCTCTTCCGATCTGGCAGGCAGATTATCATTCCGA |
| fwd_site_4_HDR_HTS | ACACTCTTTCCCTACACGACGCTCTTCCGATCTNNNNAAAGTGCTGCGATTACAGGC |
| rev_site_4_HDR_HTS | TGGAGTTCAGACGTGTGCTCTTCCGATCTGTGGCATCCAGAGACATGGT |
| fwd_site_6_HDR_HTS | ACACTCTTTCCCTACACGACGCTCTTCCGATCTNNNNATGTGGGCTGCCTAGAAAGG |
| rev_site_6_HDR_HTS | TGGAGTTCAGACGTGTGCTCTTCCGATCTCCCAGCCAAACTTGTCAACC |

FIG. 24 (cont'd)

| target site | sequence |
|---|---|
| 1 | 5'-TTTTCCAGCCCGCTGGCCCTGTAAAGGAAACTGGAACGCAAAGCATAGACTGCGCGGCGGGCCAGCCTGAATAGCTGCAAACAAGTGCAGAATATCTGAT-3' |
| 2 | 5'-CATGAAAAAGAGACTGATTGCGTGGAGTTCATGGAGTGTGAGGCATAGACTGCACGAGACATAAACCATGACTTGCAGATGAAGAAGCATTTTAAAAGT-3' |
| 3 | 5'-GACAGCCAGTGGTTAAGTCAGAACCCGACTCAGGTCAGGAAAGCAGAGACTGCCCGGGGTTGGGAAGCCGGTGAACTCAGAGATAGAAACAGGGTGGGTG-3' |
| 4 | 5'-ATTTTAAGCTGTAGTATTATGAAGGGAAATCTGGAGCGAAGAGAATAGACTGTACGGAAACCAGTTAAGAAATAGGACATGGAGGCTAGGTGCAGTGGCT-3' |
| 6 | 5'-CCTCTGCCATCACGTGCTCAGTCTGGGCCCCAAGGATTGGCCCAGGCCAGGGCTCGAGAAGCAGAAAAAAGCATCAAGCCTACAAATGCATGCTTACTT-3' |

USES OF ADENOSINE BASE EDITORS

RELATED APPLICATIONS

This application is a national stage filing under 35 U.S.C. § 371 of international PCT application, PCT/US2018/056146, filed Oct. 16, 2018, which claims priority under 35 U.S.C. § 119(e) to U.S. Provisional Application, U.S. Ser. No. 62/573,127, filed on Oct. 16, 2017, each of which is incorporated herein by reference.

GOVERNMENT SUPPORT

This invention was made with government support under Grant Nos. EB022376, HG009490, and GM118062 awarded by the National Institutes of Health, and Grant No. HR0011-17-2-0049 awarded by the Defense Advanced Research Projects Agency. The government has certain rights in the invention.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases. Since many genetic diseases in principle can be treated by effecting a specific nucleotide change at a specific location in the genome (for example, an A to G or a T to C change in a specific codon of a gene associated with a disease), the development of a programmable way to achieve such precise gene editing represents both a powerful new research tool, as well as a potential new approach to gene editing-based therapeutics.

SUMMARY OF THE INVENTION

The disclosure provides methods and compositions for treating blood diseases/disorders, such as sickle cell disease, hemochromatosis, hemophilia, and beta-thalassemia. For example, the disclosure provides therapeutic guide RNAs that target the promotor of HBG1/2 to generate point mutations that increase expression of fetal hemoglobin. As another example, the disclosure provides therapeutic guide RNAs that target mutations (e.g., pathogenic mutaions) in HBB, Factor VIII, and HFE to treat sickle cell disease, beta-thalassemia (e.g., Hb C and Hb E), hemophilia and hemochromatosis. The guide RNAs provided herein can be complexed with a base editor protein (e.g., an adenosine base editor) to generate a point mutation in a gene or gene promoter, which can correct a pathogenic mutation, generate a non-pathogenic point mutation, or modulate (e.g., increase) expression of a gene.

Provided herein are compositions, kits, and methods of modifying a polynucleotide (e.g., DNA) using an adenosine deaminase and a nucleic acid programmable DNA binding protein (e.g., Cas9). Some aspects of the disclosure provide nucleobase editing proteins which catalyze hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). To overcome this drawback, the first deoxyadenosine deaminases were evolved to accept DNA substrates and deaminate deoxyadenosine (dA) to deoxyinosine. Such adenosine deaminases are described in International Application No.: PCT/US2017/045,381, filed Aug. 3, 2017; the entire contents of which are hereby incorporated by reference. The adenosine deaminase acting on tRNA (ADAT) from *Escherichia coli* (TadA, for tRNA adenosine deaminase A), was covalently fused to a dCas9 or a Cas9 nickase domain, and fusion proteins containing mutations in the deaminase portion of the construct were assembled. In addition to *E. coli* TadA (ecTadA), other naturally occurring adenosine deaminases, such as human ADAR (adenosine deaminase acting on RNA), mouse ADA (adenosine deaminase), and human ADAT2, may be fused to a dCas9 or Cas9 nickase domain to generate adenosine nucleobase editor (ABE) fusion protein constructs. The directed evolution of these fusion proteins resulted in programmable adenosine base editors that efficiently convert target A-T base pairs to G-C base pairs with low off-target modifications and a low rate of indel (stochastic insertion or deletion) formation, especially when compared to current Cas9 nuclease-mediated HDR methods of genome editing. The ABEs disclosed herein can be used to both correct disease-associated point mutations and to introduce disease-suppressing point mutations (e.g., single nucleotide polymorphisms).

Mutations in the deaminase domain of nucleobase editing proteins were made by evolving adenosine deaminases. For example, ecTadA variants that are capable of deaminating adenosine in DNA include one or more of the following mutations: W23L, W23R, R26G, H36L, N37S, P48S, P48T, P48A, I49V, R51L, N72D, L84F, S97C, D108N, A106V, H123Y, G125A, A142N, S146C, D147Y, R152H, R152P, E155V, I156F, K157N, and K161T of SEQ ID NO: 1. It should be appreciated however, that homologous mutations may be made in other adenosine deaminases to generate variants that are capable of deaminating adenosine in DNA. FIG. 7 illustrates ecTadA variants that may be useful for the methods disclosed herein.

In the examples provided herein, exemplary nucleobase editors having the general structure of an evolved fusion protein, such as ecTadA(D108X; X=G, V, or N)-XTEN-nCas9, catalyzed A to G transition mutations in cells such as eukaryotic cells (e.g., Hek293T mammalian cells). In other examples exemplary nucleobase editors contain two ecTadA domains and a nucleic acid programmable DNA binding protein (napDNAbp). The two ecTadA domains may be the same (e.g., a homodimer), or two different ecTadA domains (e.g., a heterodimer (e.g., wild-type ecTadA and ecTadA (A106V/D108N))). For example nucleobase editors may have the general structure ecTadA-ecTadA*-nCas9, where ecTadA* represents an evolved ecTadA comprising one or more mutations of SEQ ID NO:1. Additional examples of nucleobase editors containing ecTadA variants provided herein demonstrate an improvement in performance of the nucleobase editors in mammalian cells.

Without wishing to be bound by any particular theory, the adenosine nucleobase editors described herein work by using ecTadA variants to deaminate A bases in DNA, causing A to G mutations via inosine formation. Inosine preferentially hydrogen bonds with C, resulting in A to G mutation during DNA replication. When covalently tethered to Cas9 (or another nucleic acid programmable DNA binding protein), the adenosine deaminase (e.g., ecTadA) is localized to a gene of interest and catalyzes A to G mutations in the ssDNA substrate. This editor can be used to target and revert single nucleotide polymorphisms (SNPs) in disease-relevant genes, which require A to G reversion. This editor can also be used to target and revert single nucleotide polymorphisms (SNPs) in disease-relevant genes, which require T to C reversion by mutating the A, opposite of the T, to a G. The T may then be replaced with a C, for example by base excision repair mechanisms, or may be changed in subsequent rounds of DNA replication. Thus, the adenosine base editors described herein may deaminate the A nucleobase to give a nucleotide sequence that is not associated with a disease or disorder. In some aspects, the adenosine base editors described herein may be useful for deaminating an adenosine (A) nucleobase in a gene promoter. In some embodiments, deamination leads to induce transcription of the gene. The induction of transcription of a gene leads to an increase in expression of the protein encoded by the gene (e.g., the gene product). A guide RNA (gRNA) bound to the base editor comprises a guide sequence that is complementary to a target nucleic acid sequence in the promoter. In some embodiments, the target nucleic acid sequence is a nucleic acid sequence in the promoter of the HBG1 and/or the HBG2 gene. In some embodiments, the target nucleic acid sequence in the promotor comprises the nucleic acid sequence 5'-CTTGGGGGCCCCTTCCCCACACTA-3' (SEQ ID NO: 838), 5'-CTTGGGGGCCCCTTCCC-CACACT-3' (SEQ ID NO: 839), 5'-CTTGGGGGCCCCTTCCCCACAC-3' (SEQ ID NO: 840), 5'-CTTGGGGGCCCCTTCCCCACA-3' (SEQ ID NO: 841), 5'-CTTGGGGGCCCCTTCCCCAC-3' (SEQ ID NO: 842), 5'-CTTGGGGGCCCCTTCCCCA-3' (SEQ ID NO: 843), 5'-CTTGGGGGCCCCTTCCCC-3' (SEQ ID NO: 844), or 5'-CTTGGGGGCCCCTTCCC-3' (SEQ ID NO: 845). In some embodiments, the target nucleic acid sequence in the promoter comprises the nucleic acid sequence 5'-CTTGGGGGCCCCTTCCCCAC-3' (SEQ ID NO: 842). In some embodiments, the target nucleic acid sequence in the promoter comprises a T at nucleic acid position 14 (shown in bold) of any one of SEQ ID NOs: 838-845, and the deamination of the A nucleobase that is complementary to the T at position 14 results in a T to C mutation in the target nucleic acid sequence. In some embodiments, the target nucleic acid further comprises 5'-CCT-3' at the 5' end of any one of SEQ ID NOs: 838-845. In some embodiments, the guide RNA comprises at least 15, 16, 17, 18, 19, 20, 21, 22, 23, 24, or 26 contiguous nucleic acids that are 100% complementary to the target nucleic acid sequence in the promoter. In some embodiments, the guide sequence of the gRNA comprises the nucleic acid sequence 5'-UCAU-GUGGGGAAGGGGCCCCCAAG-3' (SEQ ID NO: 846), 5'-CAUGUGGGGAAGGGGCCCCCAAG-3' (SEQ ID NO: 847), 5'-AUGUGGGGAAGGGGCCCCCAAG-3' (SEQ ID NO: 848), 5'-UGUGGGGAAGGGGCCCCCAAG-3' (SEQ ID NO: 849), 5'-GUGGGGAAGGGGCCCCCAAG-3' (SEQ ID NO: 850), 5'-UGGGGAAGGGGCCCCCAAG-3' (SEQ ID NO: 851) 5'-GGGGAAGGGGCCCCCAAG-3' (SEQ ID NO: 852), or 5'-GGGAAGGGGCCCCCAAG-3' (SEQ ID NO: 853). In some embodiments, the guide sequence of the gRNA comprises the nucleic acid sequence 5'-GUGGGGAAGGGGCCCCCAAG-3' (SEQ ID NO: 850). In some embodiments, the guide sequence of the gRNA comprises the nucleic acid sequence of any one of SEQ ID NOs: 254-280. In some embodiments, the base editor comprises a fusion protein comprising (i) a nucleic acid programmable DNA binding protein (napDNAbp) and (ii) an adenosine deaminase is used in combination with a guide RNA that is complementary to a target sequence of interest to deaminate a nucleobase. In some embodiments, the nucleic acid programmable DNA binding protein (napDNAbp) is a Cas9 domain. In some embodiments, the Cas9 domain is a Cas9 nickase (nCas9). The adenosine deaminse may be any adenosine deaminase described herein. In some embodiments, the adenosine demainse is an E. coli TadA (ecTadA) comprising one or more mutations of SEQ ID NO: 1. In some embodiments, the adenosine deaminse is an ecTadA comprising the amino acid sequence of SEQ ID NO: 1.

Thus, in some aspects, the base editor and guide RNA complexes described herein may be useful for treating a disease or a disorder caused by a C to T mutation in the promoter of the HBG1 and/or the HBG2 gene. In some embodiments, the disease or disorder is one of the blood. In certain embodiments, the disease or disorder is anemia. In some embodiments, the anemia is sickle-cell anemia. For example, a –198 C to T mutation in the promoter of the HBG1 and/or the HBG2 gene leads to a decrease in γ-globin expression levels, which can promote the development of sickle cell disease (SCD) and β-thalassemia. The deamination of the adenosine nucleobase in the promoter results in a T-A base pair in the promoter being mutated to a C-G base pair in the promoter of the HBG1 and/or the HBG2 gene. The deamination of the adenosine nucleobase promotes a sequence that is promoted with hereditary persistence to fetal hemoglobin (HPFH). In some embodiments, deaminating the adenosine nucleobase in the promoter leads to an increase in transcription of the HBG1 gene. In some embodiments, deaminating the adenosine nucleobase in the promoter leads to an increase in the amount of the HBG1 protein. In some embodiments, deaminating the adenosine nucleobase in the promoter leads to an increase in transcription of the HBG2 gene. In some embodiments, deaminating the adenosine nucleobase in the promoter leads to an increase in the amount of the HBG2 protein. In some embodiments, deaminating the adenosine nucleobase in the promoter leads to an increase in transcription of both the HBG1 and HBG2 genes. In some embodiments, deaminating the adenosine nucleobase in the promoter leads to an increase in the amount of both the HBG1 and HBG2 proteins.

In yet another aspect, the adenosine base editors described herein may be useful for deaminating an adenosine (A) nucleobase in a gene to correct a point mutation in the gene. In some embodiments, the gene may comprise a mutation in a codon that results in a change in the amino acid encoded by the mutant codon as compared to the wild-type codon. A guide RNA (gRNA) bound to the base editor comprises a guide sequence that is complementary to a target nucleic acid sequence in the gene. In some embodiments, the target nucleic acid sequence is a nucleic acid sequence in the HFE gene. In some embodiments, the HFE gene comprises a C to T mutation. Deamination of the A nucleobase complementary to the T by a base editor and guide RNA complex described herein corrects the C to T mutation (for example, see FIG. 7). In some embodiments, the target nucleic acid sequence in the promotor comprises the nucleic acid sequence. In some embodiments, the HFE gene encodes a human hemochromatosis (HFE) protein comprising a Cys to Tyr mutation (e.g., C282Y). Deamination of the A nucleobase complementary to the T by a base editor and guide RNA complex described herein corrects the Cys to Tyr mutation in the HFE protein, resulting in expression of the wild-type protein. In some embodiments, the target nucleic acid sequence in the HFE gene comprises the nucleic acid sequence 5'-GGGTGCTCCACCTGGTACGTATAT-3' (SEQ ID NO: 854), 5'-GGGTGCTCCACCTGGTACGTATA-3' (SEQ ID NO: 855), 5'-GGGTGCTCCACCTGGTACGTAT-3' (SEQ ID NO: 856), 5'-GGGTGCTC-CACCTGGTACGTA-3' (SEQ ID NO: 857), 5'-GGGTGCTCCACCTGGTACGT-3' (SEQ ID NO: 858), 5'-GGGTGCTCCACCTGGTACG-3' (SEQ ID NO: 859), 5'-GGGTGCTCCACCTGGTAC-3' (SEQ ID NO: 860), or 5'-GGGTGCTCCACCTGGTA-3' (SEQ ID NO: 861). In some embodiments, the target nucleic acid further comprises 5'-CCT-3' at the 5' end of any one of the nucleic acid sequences of SEQ ID NOs: 854-861. In some embodiments, the target nucleic acid sequence in the HFE gene comprises the nucleic acid sequence 5'-GGGTGCTCCACCTGGTACGT-3' (SEQ ID NO: 858). In some embodiments, the guide RNA comprises at least 15, 16, 17, 18, 19, 20, 21, 22, 23, 24, or 26 contiguous nucleic acids that are 100% complementary to the target nucleic acid sequence in the HFE gene. In some embodiments, the guide sequence of the gRNA comprises the nucleic acid sequence 5'-AUAUACGUACCAGGUGGAGCACCC-3' (SEQ ID NO: 862), 5'-UAUACGUACCAGGUGGAGCACCC-3' (SEQ ID NO: 863), 5'-AUACGUACCAGGUGGAGCACCC-3' (SEQ ID NO: 864), 5'-UACGUACCAGGUGGAGCACCC-3' (SEQ ID NO: 865), 5'-ACGUACCAGGUGGAGCACCC-3' (SEQ ID NO: 866), 5'-CGUACCAGGUGGAGCACCC-3' (SEQ ID NO: 867), 5'-GUACCAGGUGGAGCACCC-3' (SEQ ID NO: 868), or 5'-UACCAGGUGGAGCACCC-3' (SEQ ID NO: 869). In some embodiments, the guide sequence of the gRNA further comprises a G at the 5' end of any one of the nucleic acid sequences of SEQ ID NOs: 862-869. In some embodiments, the guide sequence of the gRNA comprises the nucleic acid sequence 5'-GACGUACCAGGUGGAGCACCC-3' (SEQ ID NO: 870). In some embodiments, the base editor comprises a fusion protein comprising (i) a nucleic acid programmable DNA binding protein (napDNAbp) and (ii) an adenosine deaminase is used in combination with a guide RNA that is complementary to a target sequence of interest to demainate a nucleobase. In some embodiments, the nucleic acid programmable DNA binding protein (napDNAbp) is a Cas9 domain. In some embodiments, the Cas9 domain is a Cas9 nickase (nCas9). The adenosine deaminse may be any adenosine deaminase described herein. In some embodiments, the adenosine demainse is an E. coli TadA (ecTadA) comprising one or more mutations of SEQ ID NO: 1. In some embodiments, the adenosine deaminse is an ecTadA comprising the amino acid sequence of SEQ ID NO: 1.

Thus, in some aspects, the base editor and guide RNA complexes described herein may be useful for treating a disease or a disorder caused by a C to T mutation in the HFE gene. In some embodiments, the disorder is an iron storage disorder. In some embodiments, the iron storage disorder is hereditary hemochromatosis (HHC). In some embodiments, deaminating the adenosine nucleobase in the HFE gene results in a T-A base pair in the HFE gene being mutated to a C-G base pair in the HFE gene. In some embodiments, deaminating the adenosine nucleobase in the HFE gene leads to an increase in an HFE protein function transcribed from the HFE gene. In some embodiments, deaminating the adenosine nucleobase in the HFE gene results in correcting a sequence associated with hereditary hemochromatosis (HHC). In some embodiments, deaminating the adenosine nucleobase in the HFE gene ameliorates one or more symptoms of the iron storage disorder.

In some embodiments, the adenosine deaminases provided herein are capable of deaminating an adenosine in a nucleic acid molecule. In some embodiments, the method of deaminating an adenosine nucleobase comprises contacting the nucleic acid molecule in a cell with a complex comprising (i) an adenosine base editor and (ii) a guide RNA in vitro. In some embodiments, the method of deaminating an adenosine nucleobase comprises contacting the nucleic acid molecule in cell with a complex comprising (i) an adenosine base editor and (ii) a guide RNA in vivo. In some embodiments, the method of deaminating an adenosine nucleobase comprises contacting the nucleic acid molecule in a cell with a complex comprising (i) an adenosine base editor and (ii) a guide RNA, wherein the cell is in a subject. In some embodiments, the cell is an immortalized lymphoblastoid cell (LCL). Other aspects of the disclosure provide fusion proteins comprising a Cas9 domain and an adenosine deaminase domain, for example, an engineered deaminase domain capable of deaminating an adenosine in DNA. In some embodiments, the fusion protein comprises one or more of a nuclear localization sequence (NLS), an inhibitor of inosine base excision repair (e.g., dISN), and/or one or more linkers.

In some aspects, the disclosure provides an adenosine deaminase capable of deaminating an adenosine in a deoxyribonucleic acid (DNA) substrate. In some embodiments, the adenosine deaminase is from a bacterium, for example, E. coli or S. aureus. In some embodiments, the adenosine deaminase is a TadA deaminase. In some embodiments, the TadA deaminase is an E. coli TadA deaminase (ecTadA). In some embodiments, the adenosine deaminase comprises a D108X mutation in SEQ ID NO: 1, or a corresponding mutation in another adenosine deaminase, wherein X is any amino acid other than the amino acid found in the wild-type protein. In some embodiments, X is G, N, V, A, or Y. In some embodiments, the adenosine deaminase comprises a D108N mutation in SEQ ID NO: 1, or a corresponding mutation in another adenosine deaminase. In some embodiments, the adenosine deaminase comprises a A106X mutation in SEQ ID NO: 1, or a corresponding mutation in another adenosine deaminase, wherein X is any amino acid other than the amino acid found in the wild-type protein. In some embodiments, X is V, G, I, L, or A. In some embodiments, the adenosine deaminase comprises a A106V mutation in SEQ ID NO: 1, or a corresponding mutation in another adenosine deaminase. In some embodiments, the adenosine deaminase comprises a A106X and a D108X mutation in SEQ ID NO: 1, or corresponding mutations in another adenosine deaminase, wherein X is any amino acid other than the amino acid found in the wild-type protein. In some embodiments, the adenosine deaminase comprises a A106V and a D108N mutation in SEQ ID NO: 1, or corresponding mutations in another adenosine deaminase. In some embodiments, the adenosine deaminse comprises a A106X, D108X, D147X, E155X, L84X, H123X, and I156X mutation, or corresponding mutations in another adenosine deaminase, wherein X is any amino acid other than the amino acid found in the wild-type protein. In some embodiments, the adenosine deaminse comprises a A106V, D108N, D147Y, E155V, L84F, H123Y, and I156F mutation, or corresponding mutations in another adenosine deaminase. In some embodiments, the adenosine deaminase comprises a A106X, D108X, D147X, E155X, L84X, H123X, I156X, H36X, R51X, S146X, and K157X mutation, or corresponding mutations in another adenosine deaminase, wherein X is any amino acid other than the amino acid found in the wild-type protein. In some embodiments, the adenosine deaminse comprises a A106V, D108N, D147Y, E155V, L84F, H123Y, I156F, H36L, R51L, S146C, and K157N mutation, or corresponding mutations in another adenosine deaminase. In some embodiments, the adenosine comprises a A106X, D108X, D147X, E155X, L84X, H123X, I156X, H36X, R51X, S146X, K157X, W23X, P48X, and R152X mutation, or the corresponding mutations in another adenosine deaminase, wherein X is any amino acid other than the amino acid found in the wild-type protein. In some embodiments, the adenosine deaminase comprises a A106V, D108N, D147Y, E155V, L84F, H123Y, I156F, H36L, R51L, S146C, K157N, W23R, P48A, and R152P mutation, or the corresponding mutations in another adenosine deaminase. It should be appreciated that the adenosine deaminases provided herein may contain one or more of the mutations provided herein in any combination.

In another aspect, the disclosure provides adenosine nucleobase editors (ABEs) with broadened target sequence compatibility. In general, native ecTadA deaminates the adenine in the sequence UAC (e.g., the target sequence) of the anticodon loop of tRNA$^{Arg}$. Without wishing to be bound by any particular theory, in order to expand the utility of ABEs comprising one or more ecTadA domains, such as any of the adenosine deaminases provided herein, the adenosine deaminase proteins were optimized to recognize a wide variety of target sequences within the protospacer sequence without compromising the editing efficiency of the adenosine nucleobase editor complex. In some embodiments, the target sequence is 5'-NAN-3', wherein N is T, C, G, or A. For example, target sequences are shown in FIG. 3A. In some embodiments, the target sequence comprises 5'-TAC-3'. In some embodiments, the target sequence comprises 5'-GAA-3'.

In some embodiments, the base editor comprises or consists of the amino acid sequence of SEQ ID NO: 707. In some embodiments, the base editor comprises or consists of the amino acid sequence of SEQ ID NO: 708. In some embodiments, the base editor comprises or consists of the amino acid sequence of SEQ ID NO: 709. In some embodiments, the base editor comprises or consists of the amino acid sequence of SEQ ID NO: 710. In some embodiments, the base editor comprises or consists of the amino acid sequence of SEQ ID NO: 711.

In another aspect, the present disclosure provides pharmaceutical compositions comprising a complex comprising a fusion protein comprising (i) a nucleic acid programmable DNA binding protein (napDNAbp), (ii) an adenosine deaminase, and (iii) a guide RNA that directs the fusion protein to a target sequence of interest; and optionally a pharmaceutically acceptable excipient. The adenosine deaminase can be any of the adenosine deaminase domains described herein, or any combination thereof. In some embodiments, the napDNAbp is a Cas9 domain. In some embodiments, the Cas9 domain is a Cas9 nickase (nCas9). In some embodiments, the guide RNA comprises a guide nucleic acid sequence that directs the fusion protein to the promoter of the HBG1 and/or the HBG2 gene. In some embodiments, the guide nucleic acid sequence comprises a nucleic acid sequence of SEQ ID NOs: 846-853. In some embodiments, the guide RNA comprises a nucleic acid sequence that directs the fusion protein to the HFE gene. In some embodiments, the guide nucleic acid sequence comprises a nucleic acid sequence of SEQ ID NOs: 862-870. In some embodiments, the pharmaceutical composition is administered to a subject in need thereof (e.g., to treat a disease or disorder). In some embodiments, the subject has a blood disease. In some embodiments, the blood disease is anemia. In some embodiments, the anemia is sickle cell anemia. In some embodiments, the subject has an iron storage disorder. In some embodiments, the iron storage disorder is hereditary hemochromatosis (HHC). In yet another aspect, the present disclosure provides kits comprising a nucleic acid construct, comprising (a) a nucleic acid sequence encoding a fusion protein comprising (i) a nucleic acid programmable DNA binding protein (napDNAbp) and (ii) an adenosine deaminase; (b) a heterologous promoter that drives expression of the sequence of (a); and (c) an expression construct encoding a guide RNA backbone, wherein the construct comprises a cloning site positioned to allow the cloning of a nucleic acid sequence identical or complementary to a target sequence into the guide RNA backbone. The adenosine deaminase can be any of the adenosine deaminase domains described herein, or any combination thereof. In some embodiments, the napDNAbp is a Cas9 domain. In some embodiments, the Cas9 domain is a Cas9 nickase (nCas9). In some embodiments, the guide RNA comprises a nucleic acid sequence that directs the fusion protein to the promoter of the HBG1 and/or the HBG2 gene. In some embodiments, the target nucleic acid sequence comprises the nucleic acid sequence of any one of SEQ ID NOs: 838-845. In some embodiments, the guide RNA comprises a nucleic acid sequence that directs the fusion protein to the HFE gene. In some embodiments, the target nucleic acid sequence comprises the nucleic acid sequence of any one of SEQ ID NOs: 854-861.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 1A: Relative distribution of the base pair changes required to correct known pathogenic human SNPs in the ClinVar database. FIG. 1B: The hydrolytic deamination of adenosine (A) forms inosine (I), which is read as guanosine (G) by polymerase enzymes. FIG. 1C: ABE-mediated A•T to G•C base editing strategy. ABEs contain a hypothetical deoxyadenosine deaminase, which is not known to exist in nature, and a catalytically impaired Cas9. They bind a double-stranded DNA target of interest in a guide RNA-programmed manner, exposing a small bubble of single stranded DNA in the "R-loop" complex. The deoxyadenosine deaminase domain catalyzes deoxyadenosine to deoxyinosine formation within this single-stranded bubble. Following DNA repair or replication, the original A•T base pair is replaced with a G•C base pair at the target site.

FIG. 2A: Strategy to evolve a DNA deoxyadenosine deaminase starting from an RNA adenosine deaminase. A library of E. coli cells each harbor a plasmid expressing a mutant ecTadA (TadA*) gene fused to catalytically dead Cas9 (dCas9) and a selection plasmid expressing a defective antibiotic resistance gene requiring one or more A•T to G•C mutations to restore antibiotic resistance. Mutations from TadA* variants surviving each round of mutation and selection were imported into a mammalian ABE architecture and assayed in human cells for programmable A•T to G•C base editing activity. FIG. 2B: Genotypes of a subset of evolved ABEs arising from each round of evolution. For a list of all 57 evolved ABE genotypes characterized in this work, see FIG. 7. The dimerization state (monomer, homodimer of evolved TadA* domains, or heterodimer of wild-type TadA—evolved TadA*) and linker length (in number of amino acids) are also listed. Mutations are colored based on the round of evolution from which they were identified. FIG. 2C: Three views of the E. coli TadA deaminase structure (PDB 1Z3A) aligned with the structure of S. aureus TadA (not shown) complexed with tRNAArg2 (PDB 2B3J). The UAC anticodon loop of the tRNA is the endogenous substrate of wild-type TadA. The TadA dimer and the tRNA anticodon loop are shown on the left; residues near the 2' hydroxyl group of the ribose of the U upstream of the substrate adenosine are shown in the middle; residues that mutated during ABE evolution and surround the UAC substrate are shown on the right. Wildtype residues are colored to correspond to the mutations emerging from each round of evolution, and to the genotype table in FIG. 2B.

FIG. 3A: Table of 19 human genomic DNA test sites (left) with corresponding locations on human chromosomes (right). The sequence context (target motif) of the edited A in red is shown for each site. PAM sequences are shown in blue.

FIG. 3B: A•T to G•C base editing efficiencies in HEK293T cells of round 1 and round 2 ABEs at six human genomic DNA sites. FIG. 3C: A•T to G•C base editing efficiencies in HEK293T cells of round 3, round 4, and round 5 ABEs at six human genomic DNA sites. ABE2.9 editing is shown for comparison. Values and error bars reflect the mean and s.d. of three independent biological replicates performed on different days. Homodimer indicates fused TadA*-TadA*-Cas9 nickase architecture; heterodimer indicates fused wtTadA-TadA*-Cas9 nickase architecture. Sequences correspond from top to bottom to SEQ ID NOs: 91-109.

FIG. 4A: A•T to G•C base editing efficiencies in HEK293T cells of round 6 and round 7 ABEs at six human genomic DNA sites. ABE5.3 editing is shown for comparison. FIG. 4B: A•T to G•C base editing efficiencies in HEK293T cells of round 6 and round 7 ABEs at an expanded set of human genomic sites. Sites 1-17 collectively include every possible NAN sequence context flanking the target A. ABE5.3 editing is shown for comparison. Values and error bars reflect the mean and s.d. of three independent biological replicates performed on different days. All ABEs shown in FIGS. 4A and 4B are heterodimers of the wtTadA-TadA*-Cas9 nickase architecture.

FIGS. 5A to 5C show activity window and product purity of late-stage ABEs. FIG. 5A: Relative A•T to G•C base editing efficiencies in HEK293T cells of late-stage ABEs at protospacer positions 1-9 in two human genomic DNA sites that together place an A at each of these positions. Values are normalized to the maximum observed efficiency at each of the two sites for each ABE=1. FIG. 5B: Relative A•T to G•C base editing efficiencies in HEK293T cells of late-stage ABEs at protospacer positions 1-18 and 20 across all 19 human genomic DNA sites tested. Values are normalized to the maximum observed efficiency at each of the 19 sites for each ABE=1. FIG. 5C: Product distributions at two representative human genomic DNA sites in HEK293T cells treated with ABE7.10 or ABE7.9 and the corresponding sgRNA, or in untreated HEK293T cells. Indel frequencies are shown at the right. For FIGS. 5A and 5B, values and error bars reflect the mean and s.d. of three independent biological replicates performed on different days. Sequences correspond from top to bottom to SEQ ID NOs: 110-111.

FIGS. 6A to 6C show comparison of ABE7.10-mediated base editing and Cas9-mediated HDR, and application of ABE7.10 to two disease-relevant SNPs. FIG. 6A: A•T to G•C base editing efficiencies in HEK293T cells treated either with ABE7.10, or with Cas9 nuclease and an ssDNA donor template (following the CORRECT HDR method 41) targeted to five human genomic DNA sites. FIG. 6B: Comparison of indel formation in HEK293T cells treated as described in FIG. 6A. FIG. 6C: Application of ABE to install a disease-suppressing SNP, or to correct a disease inducing SNP. Top: ABE7.10-mediated-198TaC mutation (on the strand complementary to the one shown in the sequencing data tables) in the promoter region of HBG1 and HBG2 genes in HEK293T cells. The target A is at position 7 of the protospacer. Bottom: ABE7.10-mediated reversion of the C282Y mutation in the HFE gene in LCL cells. This mutation is a common cause of hereditary hemochromatosis. The target A is at position 5 of the protospacer.

FIG. 7 shows genotype table of all ABEs described in this work. Mutations are colored based on the round of evolution in which they were identified.

FIG. 8A: A•T to G•C base editing efficiencies in HEK293T cells of various wild-type RNA adenine deaminases fused to Cas9 nickase at six human genomic target DNA sites. Values reflect the mean and standard deviation of three biological replicates performed on different days. FIG. 8B: A•T to G•C base editing efficiencies in HEK293T cells of ABE2 editors with altered fusion orientations and linker lengths at six human genomic target DNA sites. FIG. 8C: A•T to G•C base editing efficiencies in HEK293T cells at six human genomic target DNA sites of ABE2 editors fused to catalytically inactivated alkyl-adenosine glycosylase (AAG) or endonuclease V (EndoV), two proteins that bind inosine in DNA.

FIG. 8D: A•T to G•C base editing efficiencies of ABE2.1 in HAP1 cells at site 1 with or without AAG. Values and error bars in FIGS. 8B and 8C reflect the mean and s.d. of three independent biological replicates performed on different days.

Figure 9:
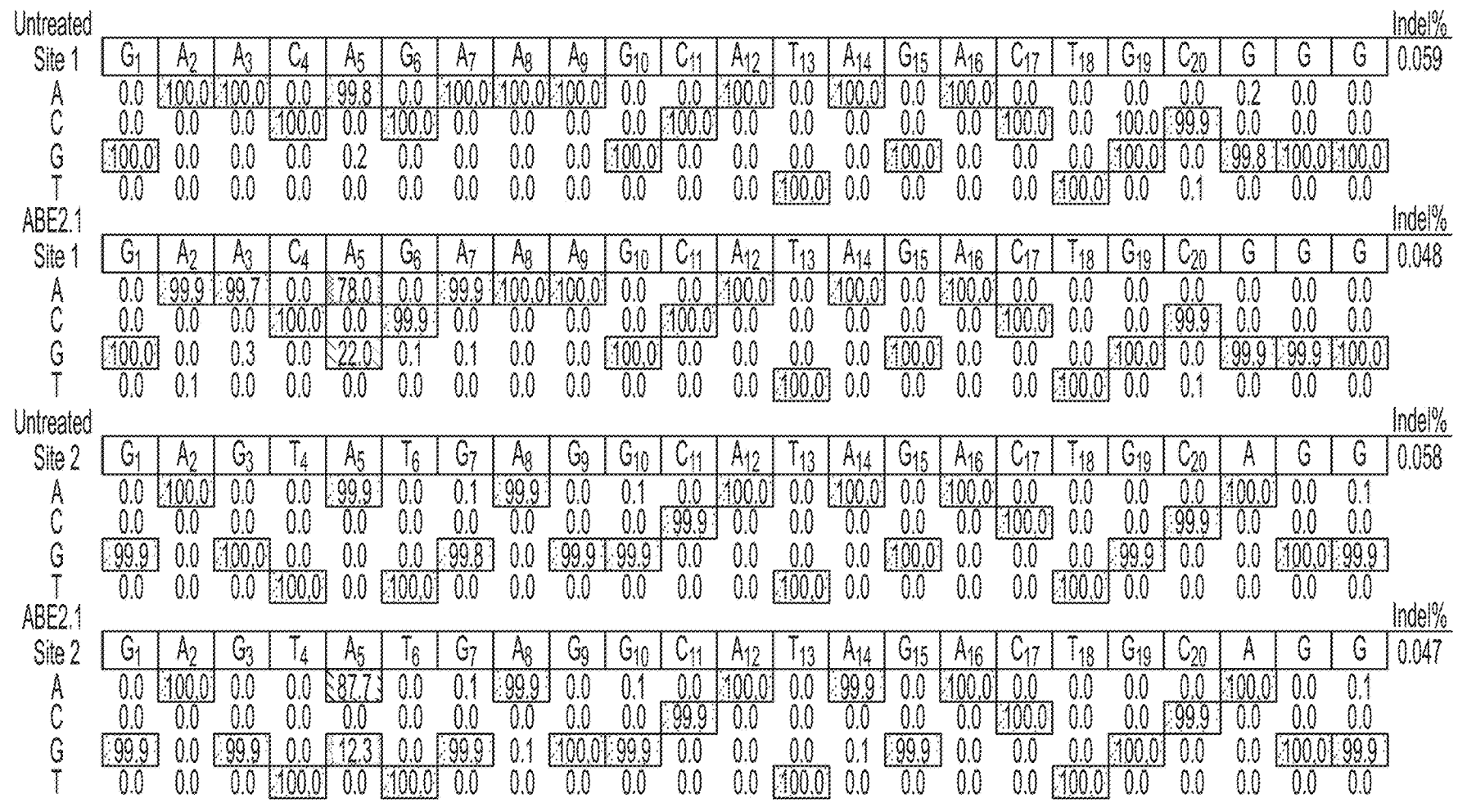
Figure 9:
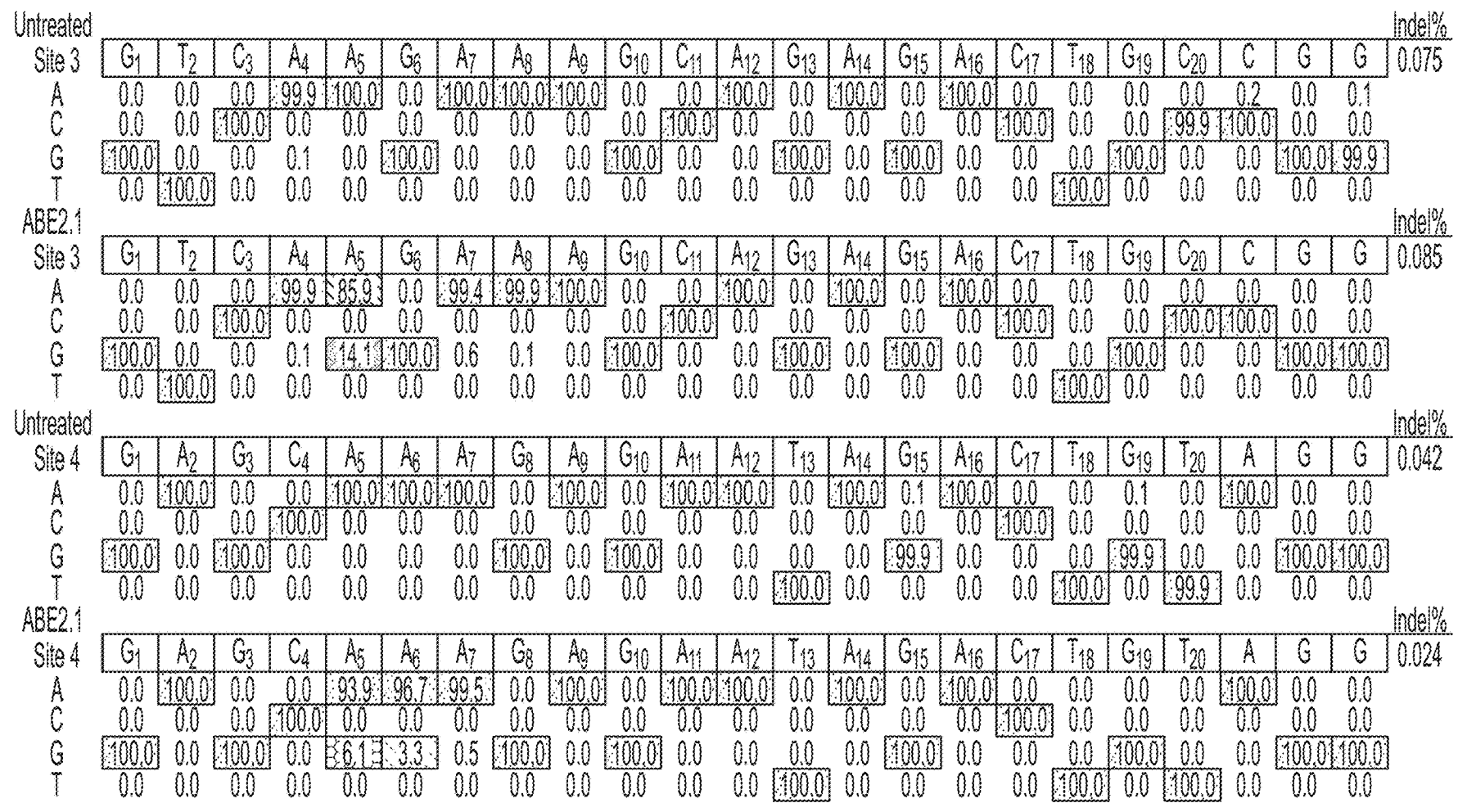

FIG. 9 shows high-throughput DNA sequencing analysis of HEK293T cells treated with ABE2.1 and sgRNAs targeting each of six human genomic sites. One representative replicate is shown. Data from untreated HEK293T cells are shown for comparison.

FIG. 10A: A•T to G•C base editing efficiencies in HEK293T cells at six human genomic target DNA sites of ABE2 variants with different engineered dimeric states. Data plotted is the mean value of three biological replicates. FIG. 10B: A•T to G•C base editing efficiencies in HEK293T cells at six human genomic target DNA sites of ABE3.1 variants differing in their dimeric state (homodimer of TadA*-TadA*-Cas9 nickase, or heterodimer of wild-type TadA-TadA*-Cas9 nickase), in the length of the TadA-TadA linker, and in the length of the TadA-Cas9 nickase linker. See FIG. 7 for ABE genotypes and architectures. FIG. 10C: Colony-forming units on 2×YT agar with 256 µg/mL of spectinomycin of E. coli cells expressing an sgRNA targeting the I89T defect in the spectinomycin resistance gene and a TadA*-dCas9 editor lacking or containing the A142N mutation identified in evolution round 4 Successful A•T to G•C base editing at the target site restores spectinomycin resistance. Values and error bars in FIGS. 10A and 10B reflect the mean and s.d. of three independent biological replicates performed on different days.

FIG. 11A: A•T to G•C base editing efficiencies in HEK293T cells at six human genomic target DNA sites of two ABE3.1 variants with two pairs of mutations isolated from spectinomycin selection of the round 5 library. FIG. 11B: A•T to G•C base editing efficiencies in HEK293T cells at six human genomic target DNA sites of ABE5 variants with different linker lengths. See FIG. 7 for ABE genotypes and architectures. Values and error bars reflect the mean and s.d. of three independent biological replicates performed on different days.

FIG. 12C: A•T to G•C base editing efficiencies in U2OS cells at six human genomic target DNA sites of ABE7.8-7.10. The lower editing efficiencies observed in U2OS cells compared with HEK293T cells are consistent with transfection efficiency differences between the two cell lines; typical transfection efficiencies of ~40 to 55% were observed in U2OS cells under the conditions used in this study, compared to 65-80% in HEK293T cells. Values and error bars reflect the mean and s.d. of three independent biological replicates performed on different days.

FIGS. 14A and 14B show high-throughput DNA sequencing analysis of HEK293T cells treated with five late-stage ABE variants and an sgRNA targeting −198T in the promoter of HBG1 and HBG2. One representative replicate is shown of DNA sequences at the HBG1 (FIG. 14A) and HBG2 (FIG. 14B) promoter targets. ABE-mediated base editing installs a −198T→C mutation on the strand complementary to the one shown in the sequencing data tables. Data from untreated HEK293T cells are shown for comparison.

FIG. 17 shows activities of ABE7.8, ABE7.9, and ABE7.10 at the HEK2 on-target and off-target sites previously characterized for S. pyogenes Cas9 nuclease.

FIG. 18 shows activities of ABE7.8, ABE7.9, and ABE7.10 at the HEK3 site previously characterized for on-target and off-target modification by S. pyogenes Cas9 nuclease.

FIG. 19 shows activities of ABE7.8, ABE7.9, and ABE7.10 at the HEK4 site previously characterized for on-target and off-target modification by S. pyogenes Cas9 nuclease. Although HEK4 off-target site 3 showed appreciable indel formation upon ABE treatment, this locus also showed unusually high (89%) indel formation by Cas9 nuclease and was the only tested off-target site exhibiting indel formation upon treatment with Cas9 nickases. It is speculated that this locus is unusually fragile, and that indel formation here arises from simply nicking the site, rather than from ABE-mediated adenine deamination.

FIG. 20 shows primers used for generating sgRNA plasmids. The 20-nt target protospacer is shown in red. When a target DNA sequence did not start with a 'G', a 'G' was added to the 5' end of the primer since the human U6 promoter prefers a 'G' at the transcription start site. The pFYF sgRNA plasmids described previously were used as a template for PCR amplification.

FIG. 21 shows primers used for generating bacterial TadA* libraries.

FIG. 22 shows starting constructs used for each round of TadA* mutagenesis and selection in E. coli. All plasmids contain an SC101 origin of replication, a β-lactamase gene for plasmid maintenance with carbenicillin, a $P_{BAD}$ promoter driving TadA*-dCas9 expression, and a lac promoter driving sgRNA transcription. The architecture of the base editors used during bacterial selection is: TadA*-linker(16 aa)-dCas9.

FIG. 23 shows antibiotic selection plasmids and their corresponding E. coli antibiotic minimum inhibitory concentrations (MICs).

FIG. 24 shows primers used for mammalian cell genomic DNA amplification.

FIG. 25 shows 100-mer single-stranded oligonucleotide donor templates (ssODNs) used in HDR experiments.

DEFINITIONS

Figure 1A:
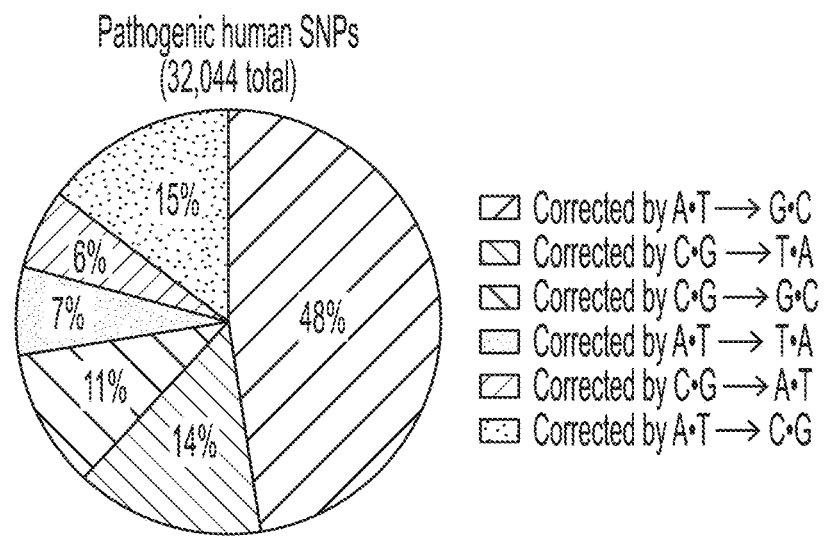
FIGS. 1A to 1C show scope and overview of base editing by an A•T to G•C base editor (ABE).

As used herein and in the claims, the singular forms "a," "an," and "the" include the singular and the plural unless the context clearly indicates otherwise. Thus, for example, a reference to "an agent" includes a single agent and a plurality of such agents.

The term "deaminase" or "deaminase domain" refers to a protein or enzyme that catalyzes a deamination reaction. In some embodiments, the deaminase is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA deaminase (ecTadA). In some embodiments, the TadA deaminase is a truncated E. coli TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine In some embodiments, the TadA deaminase is an N-terminal truncated TadA. In certain embodiments, the adenosine deaminase comprises the amino acid sequence:

(SEQ ID NO: 1)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD.

In some embodiments the TadA deaminase is a full-length *E. coli* TadA deaminase. For example, in certain embodiments, the adenosine deaminase comprises the amino acid sequence:

(SEQ ID NO: 84)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

*Staphylococcus aureus* TadA:
(SEQ ID NO: 8)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

*Bacillus subtilis* TadA:
(SEQ ID NO: 9)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF

GAFDPKGGCSGTLMNLLQEERFNHQAEVVSGVLEEECGGMLSAFFRELRK

KKKAARKNLSE

*Salmonella typhimurium* (S. typhimurium) TadA:
(SEQ ID NO: 371)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

*Shewanella putrefaciens* (S. putrefaciens) TadA:
(SEQ ID NO: 372)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

*Haemophilus influenzae* F3031 (H. influenzae) TadA:
(SEQ ID NO: 373)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

*Caulobacter crescentus* (C. crescentus) TadA:
(SEQ ID NO: 374)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

*Geobacter sulfurreducens* (G. sulfurreducens) TadA:
(SEQ ID NO: 375)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

The term "base editor (BE)," or "nucleobase editor (NBE)" refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA. In some embodiments, the base editor is a fusion protein comprising a nucleic acid programmable DNA binding protein (napDNAbp) fused to an adenosine deaminase. In some embodiments, the base editor is a Cas9 protein fused to an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In some embodiments, the dCas9 domain of the fusion protein comprises a D10A and a H840A mutation of SEQ ID NO: 52, or a corresponding mutation in any of SEQ ID NOs: 108-357, which inactivates the nuclease activity of the Cas9 protein. In some embodiments, the fusion protein comprises a D10A mutation and comprises a histidine at residue 840 of SEQ ID NO: 52, or a corresponding mutation in any of SEQ ID NOs: 108-357, which renders Cas9 capable of cleaving only one strand of a nucleic acid duplex. An example of a Cas9 nickase is shown in SEQ ID NO: 35.

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker comprises the amino acid sequence of any one of SEQ ID NOs: 10, 37-40, 384-386, 685-688, or 800-801. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises the amino acid sequence $(SGGS)_2$-SGSETPGTSESATPES-$(SGGS)_2$ (SEQ ID NO: 800), which may also be referred to as $(SGGS)_2$-XTEN-$(SGGS)_2$. In some embodiments, a linker comprises $(SGGS)_n$(SEQ ID NO: 37), $(GGGS)_n$(SEQ ID NO: 38), $(GGGGS)_n$(SEQ ID NO: 39), $(G)_n$, $(EAAAK)_n$(SEQ ID NO: 40), $(GGS)_n$, SGSETPGTSESATPES (SEQ ID NO: 10), $(SGGS)_n$-SGSETPGTSESATPES-$(SGGS)_n$(SEQ ID NO: 801) or $(XP)_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)).

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 4), MDSLLMNRRKFLY-QFKNVRWAKGRRETYLC (SEQ ID NO: 5), MKR-TADGSEFEPKKKRKV (SEQ ID NO: 342), or KRTADGSEFEPKKKRKV (SEQ ID NO: 343).

The term "nucleic acid programmable DNA binding protein" or "napDNAbp" refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a class 2 microbial CRISPR-Cas effector. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNAbinding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically listed in this disclosure.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (mc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or 1300 amino acids in length. In some embodiments, wild type Cas9 corresponds to Cas9 from *Streptococcus pyogenes* (NCBI Reference Sequence: NC_017053.1, SEQ ID NO: 47 (nucleotide); SEQ ID NO: 48 (amino acid)).

(SEQ ID NO: 47)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAAACCCT

ATTAACGCAAGTAGAGTAGATGCTAAAGCGATTCTTTCTGCACGATTGAG

TAAATCAAGACGATTAGAAAATCTCATTGCTCAGCTCCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATAGTGAAATAACTAAGGCTCCCCT

ATCAGCTTCAATGATTAAGCGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAGTACTACCAAAACATAGTTTGCTTTATGAGTA

TTTTACGGTTTATAACGAATTGACAAAGGTCAAATATGTTACTGAGGGAA

TGCGAAAACCAGCATTTCTTTCAGGTGAACAGAAGAAAGCCATTGTTGAT

TTACTCTTCAAAACAAATCGAAAAGTAACCGTTAAGCAATTAAAAGAAGA

TTATTTCAAAAAAATAGAATGTTTTGATAGTGTTGAAATTTCAGGAGTTG

AAGATAGATTTAATGCTTCATTAGGCGCCTACCATGATTTGCTAAAAATT

ATTAAAGATAAAGATTTTTTGGATAATGAAGAAAATGAAGATATCTTAGA

GGATATTGTTTTAACATTGACCTTATTTGAAGATAGGGGGATGATTGAGG

AAAGACTTAAAACATATGCTCACCTCTTTGATGATAAGGTGATGAAACAG

CTTAAACGTCGCCGTTATACTGGTTGGGGACGTTTGTCTCGAAAATTGAT

```
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGATATTCAAAAAGCACAGGTGTCTGGACAAGG
CCATAGTTTACATGAACAGATTGCTAACTTAGCTGGCAGTCCTGCTATTA
AAAAAGGTATTTTACAGACTGTAAAAATTGTTGATGAACTGGTCAAAGTA
ATGGGGCATAAGCCAGAAAATATCGTTATTGAAATGGCACGTGAAAATCA
GACAACTCAAAAGGGCCAGAAAAATTCGCGAGAGCGTATGAAACGAATCG
AAGAAGGTATCAAAGAATTAGGAAGTCAGATTCTTAAAGAGCATCCTGTT
GAAAATACTCAATTGCAAAATGAAAAGCTCTATCTCTATTATCTACAAAA
TGGAAGAGACATGTATGTGGACCAAGAATTAGATATTAATCGTTTAAGTG
ATTATGATGTCGATCACATTGTTCCACAAAGTTTCATTAAAGACGATTCA
ATAGACAATAAGGTACTAACGCGTTCTGATAAAAATCGTGGTAAATCGGA
TAACGTTCCAAGTGAAGAAGTAGTCAAAAAGATGAAAAACTATTGGAGAC
AACTTCTAAACGCCAAGTTAATCACTCAACGTAAGTTTGATAATTTAACG
AAAGCTGAACGTGGAGGTTTGAGTGAACTTGATAAAGCTGGTTTTATCAA
ACGCCAATTGGTTGAAACTCGCCAAATCACTAAGCATGTGGCACAAATTT
TGGATAGTCGCATGAATACTAAATACGATGAAAATGATAAACTTATTCGA
GAGGTTAAAGTGATTACCTTAAAATCTAAATTAGTTTCTGACTTCCGAAA
AGATTTCCAATTCTATAAAGTACGTGAGATTAACAATTACCATCATGCCC
ATGATGCGTATCTAAATGCCGTCGTTGGAACTGCTTTGATTAAGAAATAT
CCAAAACTTGAATCGGAGTTTGTCTATGGTGATTATAAAGTTTATGATGT
TCGTAAAATGATTGCTAAGTCTGAGCAAGAAATAGGCAAAGCAACCGCAA
AATATTTCTTTTACTCTAATATCATGAACTTCTTCAAAACAGAAATTACA
CTTGCAAATGGAGAGATTCGCAAACGCCCTCTAATCGAAACTAATGGGGA
AACTGGAGAAATTGTCTGGGATAAAGGGCGAGATTTTGCCACAGTGCGCA
AAGTATTGTCCATGCCCCAAGTCAATATTGTCAAGAAAACAGAAGTACAG
ACAGGCGGATTCTCCAAGGAGTCAATTTTACCAAAAAGAAATTCGGACAA
GCTTATTGCTCGTAAAAAGACTGGGATCCAAAAAAATATGGTGGTTTTG
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAAGACTTAATCATTAAACTACCTAAATAT
AGTCTTTTTGAGTTAGAAAACGGTCGTAAACGGATGCTGGCTAGTGCCGG
AGAATTACAAAAGGAAATGAGCTGGCTCTGCCAAGCAAATATGTGAATT
TTTTATATTTAGCTAGTCATTATGAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA
ATACGTGAACAAGCAGAAAATATTATTCATTTATTTACGTTGACGAATCT
TGGAGCTCCCGCTGCTTTTAAATATTTTGATACAACAATTGATCGTAAAC
GATATACGTCTACAAAAGAAGTTTTAGATGCCACTCTTATCCATCAATCC
ATCACTGGTCTTTATGAAACACGCATTGATTTGAGTCAGCTAGGAGGTGA
CTGA
```

(SEQ ID NO: 48)
MDKK<u>YSIGLDIGTNSVGWAVITDDYKVPSKKFKVLGNTDRHSIKKNLIGA
LLFGSGET</u>AEATRLKRTARRRYTRRKNRICYLQEIFSNEMAKVDDSFFHR
LEESFLVEEDKKHERHPIFGNIVDEVAYHEKYPTIYHLRKKLADSTDKAD
LRLIYLALAHMIKFRGHFLIEGDLNPDNSDVDKLFIQLVQIYNQLFEENP
INASRVDAKAILSARLSKSRRLENLIAQLPGEKRNGLFGNLIALSLGLTP
NFKSNFDLAEDAKLQLSKDTYDDDLDNLLAQIGDQYADLFLAAKNLSDAI
LLSDILRVNSEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGAYHDLLKI
IKDKDFLDNEENEDILEDIVLTLTLFEDRGMIEERLKTYAHLFDDKVMKQ
LKRRRYTGWGRLSRKLINGIRDKQSGKTILDFLKSDGFANRNFMQLIHDD
SLTFKEDIQKAQVSGQG<u>HSLHEQIANLAGSPAIKKGILQTVKIVDELVKV
MGHKPENIVIEMARE</u>NQTTQKG<u>QKNSRERMKRIEEGIKELGSQILKEHPV
ENTQLQNEKLYLYYLQNGRDMYVDQELDINRLSDYDVDHIVPQSFIKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK</u>
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD (single underline: HNH domain;

double underline: RuvC domain)

In some embodiments, wild type Cas9 corresponds to, or comprises SEQ ID NO:49 (nucleotide) and/or SEQ ID NO: 50 (amino acid):

(SEQ ID NO: 49)
```
ATGGATAAAAAGTATTCTATTGGTTTAGACATCGGCACTAATTCCGTTGG
ATGGGCTGTCATAACCGATGAATACAAAGTACCTTCAAAGAAATTTAAGG
TGTTGGGGAACACAGACCGTCATTCGATTAAAAAGAATCTTATCGGTGCC
CTCCTATTCGATAGTGGCGAAACGGCAGAGGCGACTCGCCTGAAACGAAC
CGCTCGGAGAAGGTATACACGTCGCAAGAACCGAATATGTTACTTACAAG
```

-continued

AAATTTTTAGCAATGAGATGGCCAAAGTTGACGATTCTTTCTTTCACCGT
TTGGAAGAGTCCTTCCTTGTCGAAGAGGACAAGAAACATGAACGGCACCC
CATCTTTGGAAACATAGTAGATGAGGTGGCATATCATGAAAAGTACCCAA
CGATTTATCACCTCAGAAAAAGCTAGTTGACTCAACTGATAAAGCGGAC
CTGAGGTTAATCTACTTGGCTCTTGCCCATATGATAAAGTTCCGTGGGCA
CTTTCTCATTGAGGGTGATCTAAATCCGGACAACTCGGATGTCGACAAAC
TGTTCATCCAGTTAGTACAAACCTATAATCAGTTGTTTGAAGAGAACCCT
ATAAATGCAAGTGGCGTGGATGCGAAGGCTATTCTTAGCGCCCGCCTCTC
TAAATCCCGACGGCTAGAAAACCTGATCGCACAATTACCCGGAGAGAAGA
AAAATGGGTTGTTCGGTAACCTTATAGCGCTCTCACTAGGCCTGACACCA
AATTTTAAGTCGAACTTCGACTTAGCTGAAGATGCCAAATTGCAGCTTAG
TAAGGACACGTACGATGACGATCTCGACAATCTACTGGCACAAATTGGAG
ATCAGTATGCGGACTTATTTTTGGCTGCCAAAAACCTTAGCGATGCAATC
CTCCTATCTGACATACTGAGAGTTAATACTGAGATTACCAAGGCGCCGTT
ATCCGCTTCAATGATCAAAAGGTACGATGAACATCACCAAGACTTGACAC
TTCTCAAGGCCCTAGTCCGTCAGCAACTGCCTGAGAAATATAAGGAAATA
TTCTTTGATCAGTCGAAAAACGGGTACGCAGGTTATATTGACGGCGGAGC
GAGTCAAGAGGAATTCTACAAGTTTATCAAACCCATATTAGAGAAGATGG
ATGGGACGGAAGAGTTGCTTGTAAAACTCAATCGCGAAGATCTACTGCGA
AAGCAGCGGACTTTCGACAACGGTAGCATTCCACATCAAATCCACTTAGG
CGAATTGCATGCTATACTTAGAAGGCAGGAGGATTTTTATCCGTTCCTCA
AAGACAATCGTGAAAGATTGAGAAAATCCTAACCTTTCGCATACCTTAC
TATGTGGGACCCCTGGCCCGAGGGAACTCTCGGTTCGCATGGATGACAAG
AAAGTCCGAAGAAACGATTACTCCATGGAATTTTGAGGAAGTTGTCGATA
AAGGTGCGTCAGCTCAATCGTTCATCGAGAGGATGACCAACTTTGACAAG
AATTTACCGAACGAAAAGTATTGCCTAAGCACAGTTTACTTTACGAGTA
TTTCACAGTGTACAATGAACTCACGAAAGTTAAGTATGTCACTGAGGGCA
TGCGTAAACCCGCCTTTCTAAGCGGAGAACAGAAGAAAGCAATAGTAGAT
CTGTTATTCAAGACCAACCGCAAAGTGACAGTTAAGCAATTGAAAGAGGA
CTACTTTAAGAAAATTGAATGCTTCGATTCTGTCGAGATCTCCGGGGTAG
AAGATCGATTTAATGCGTCACTTGGTACGTATCATGACCTCCTAAAGATA
ATTAAAGATAAGGACTTCCTGGATAACGAAGAGAATGAAGATATCTTAGA
AGATATAGTGTTGACTCTTACCCTCTTTGAAGATCGGGAAATGATTGAGG
AAAGACTAAAAACATACGCTCACCTGTTCGACGATAAGGTTATGAAACAG
TTAAAGAGGCGTCGCTATACGGGCTGGGGACGATTGTCGCGGAAACTTAT
CAACGGGATAAGAGACAAGCAAAGTGGTAAAACTATTCTCGATTTTCTAA
AGAGCGACGGCTTCGCCAATAGGAACTTTATGCAGCTGATCCATGATGAC
TCTTTAACCTTCAAAGAGGATATACAAAAGGCACAGGTTTCCGGACAAGG
GGACTCATTGCACGAACATATTGCGAATCTTGCTGGTTCGCCAGCCATCA
AAAAGGGCATACTCCAGACAGTCAAAGTAGTGGATGAGCTAGTTAAGGTC

-continued

ATGGGACGTCACAAACCGGAAAACATTGTAATCGAGATGGCACGCGAAAA
TCAAACGACTCAGAAGGGGCAAAAAACAGTCGAGAGCGGATGAAGAGAA
TAGAAGAGGGTATTAAAGAACTGGGCAGCCAGATCTTAAAGGAGCATCCT
GTGGAAAATACCCAATTGCAGAACGAGAAACTTTACCTCTATTACCTACA
AAATGGAAGGGACATGTATGTTGATCAGGAACTGGACATAAACCGTTTAT
CTGATTACGACGTCGATCACATTGTACCCCAATCCTTTTTGAAGGACGAT
TCAATCGACAATAAAGTGCTTACACGCTCGGATAAGAACCGAGGGAAAAG
TGACAATGTTCCAAGCGAGGAAGTCGTAAAGAAAATGAAGAACTATTGGC
GGCAGCTCCTAAATGCGAAACTGATAACGCAAAGAAAGTTCGATAACTTA
ACTAAAGCTGAGAGGGTGGCTTGTCTGAACTTGACAAGGCCGGATTTAT
TAAACGTCAGCTCGTGGAAACCCGCCAAATCACAAAGCATGTTGCACAGA
TACTAGATTCCCGAATGAATACGAAATACGACGAGAACGATAAGCTGATT
CGGGAAGTCAAAGTAATCACTTTAAAGTCAAAATTGGTGTCGGACTTCAG
AAAGGATTTTCAATTCTATAAAGTTAGGGAGATAAATAACTACCACCATG
CGCACGACGCTTATCTTAATGCCGTCGTAGGGACCGCACTCATTAAGAAA
TACCCGAAGCTAGAAAGTGAGTTTGTGTATGGTGATTACAAAGTTTATGA
CGTCCGTAAGATGATCGCGAAAAGCGAACAGGAGATAGGCAAGGCTACAG
CCAAATACTTCTTTTATTCTAACATTATGAATTTCTTTAAGACGGAAATC
ACTCTGGCAAACGGAGAGATACGCAAACGACCTTTAATTGAAACCAATGG
GGAGACAGGTGAAATCGTATGGGATAAGGGCCGGGACTTCGCGACGGTGA
GAAAAGTTTTGTCCATGCCCCAAGTCAACATAGTAAAGAAAACTGAGGTG
CAGACCGGAGGGTTTTCAAAGGAATCGATTCTTCCAAAAAGGAATAGTGA
TAAGCTCATCGCTCGTAAAAAGGACTGGGACCCGAAAAAGTACGGTGGCT
TCGATAGCCCTACAGTTGCCTATTCTGTCCTAGTAGTGGCAAAAGTTGAG
AAGGGAAAATCCAAGAAACTGAAGTCAGTCAAAGAATTATTGGGGATAAC
GATTATGGAGCGCTCGTCTTTTGAAAAGAACCCCATCGACTTCCTTGAGG
CGAAAGGTTACAAGGAAGTAAAAAAGGATCTCATAATTAAACTACCAAAG
TATAGTCTGTTTGAGTTAGAAAATGGCCGAAAACGGATGTTGGCTAGCGC
CGGAGAGCTTCAAAAGGGGAACGAACTCGCACTACCGTCTAAATACGTGA
ATTTCCTGTATTTAGCGTCCCATTACGAGAAGTTGAAAGGTTCACCTGAA
GATAACGAACAGAAGCAACTTTTTGTTGAGCAGCACAAACATTATCTCGA
CGAAATCATAGAGCAAATTTCGGAATTCAGTAAGAGAGTCATCCTAGCTG
ATGCCAATCTGGACAAAGTATTAAGCGCATACAACAAGCACAGGGATAAA
CCCATACGTGAGCAGGCGGAAAATATTATCCATTTGTTTACTCTTACCAA
CCTCGGCGCTCCAGCCGCATTCAAGTATTTTGACACAACGATAGATCGCA
AACGATACACTTCTACCAAGGAGGTGCTAGACGCGCACACTGATTCACCAA
TCCATCACGGGATTATATGAAACTCGGATAGATTTGTCACAGCTTGGGGG
TGACGGATCCCCCAAGAAGAAGAGGAAAGTCTCGAGCGACTACAAAGACC
ATGACGGTGATTATAAAGATCATGACATCGATTACAAGGATGACGATGAC
AAGGCTGCAGGA (SEQ ID NO: 50)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD (single underline: HNH domain;
double underline: RuvC domain)

In some embodiments, wild type Cas9 corresponds to Cas9 from *Streptococcus pyogenes* (NCBI Reference Sequence: NC_002737.2, SEQ ID NO: 51 (nucleotide); and Uniport Reference Sequence: Q99ZW2, SEQ ID NO: 52 (amino acid).

(SEQ ID NO: 51)
ATGGATAAGAAATACTCAATAGGCTTAGATATCGGCACAAATAGCGTCGG
ATGGGCGGTGATCACTGATGAATATAAGGTTCCGTCTAAAAAGTTCAAGG
TTCTGGGAAATACAGACCGCCACAGTATCAAAAAAAATCTTATAGGGGCT
CTTTTATTTGACAGTGGAGAGACAGCGGAAGCGACTCGTCTCAAACGGAC
AGCTCGTAGAAGGTATACACGTCGGAAGAATCGTATTTGTTATCTACAGG
AGATTTTTTCAAATGAGATGGCGAAAGTAGATGATAGTTTCTTTCATCGA
CTTGAAGAGTCTTTTTTGGTGGAAGAAGACAAGAAGCATGAACGTCATCC
TATTTTTGGAAATATAGTAGATGAAGTTGCTTATCATGAGAAATATCCAA
CTATCTATCATCTGCGAAAAAAATTGGTAGATTCTACTGATAAAGCGGAT
TTGCGCTTAATCTATTTGGCCTTAGCGCATATGATTAAGTTTCGTGGTCA
TTTTTTGATTGAGGGAGATTTAAATCCTGATAATAGTGATGTGGACAAAC
TATTTATCCAGTTGGTACAAACCTACAATCAATTATTTGAAGAAAACCCT
ATTAACGCAAGTGGAGTAGATGCTAAAGCGATTCTTTCTGCACGATTGAG
TAAATCAAGACGATTAGAAAATCTCATTGCTCAGCTCCCCGGTGAGAAGA
AAAATGGCTTATTTGGGAATCTCATTGCTTTGTCATTGGGTTTGACCCCT
AATTTTAAATCAAATTTTGATTTGGCAGAAGATGCTAAATTACAGCTTTC
AAAAGATACTTACGATGATGATTTAGATAATTTATTGGCGCAAATTGGAG
ATCAATATGCTGATTTGTTTTTGGCAGCTAAGAATTTATCAGATGCTATT
TTACTTTCAGATATCCTAAGAGTAAATACTGAAATAACTAAGGCTCCCCT
ATCAGCTTCAATGATTAAACGCTACGATGAACATCATCAAGACTTGACTC
TTTTAAAAGCTTTAGTTCGACAACAACTTCCAGAAAAGTATAAAGAAATC
TTTTTTGATCAATCAAAAAACGGATATGCAGGTTATATTGATGGGGGAGC
TAGCCAAGAAGAATTTTATAAATTTATCAAACCAATTTTAGAAAAAATGG
ATGGTACTGAGGAATTATTGGTGAAACTAAATCGTGAAGATTTGCTGCGC
AAGCAACGGACCTTTGACAACGGCTCTATTCCCCATCAAATTCACTTGGG
TGAGCTGCATGCTATTTTGAGAAGACAAGAAGACTTTTATCCATTTTTAA
AAGACAATCGTGAGAAGATTGAAAAAATCTTGACTTTTCGAATTCCTTAT
TATGTTGGTCCATTGGCGCGTGGCAATAGTCGTTTTGCATGGATGACTCG
GAAGTCTGAAGAAACAATTACCCCATGGAATTTTGAAGAAGTTGTCGATA
AAGGTGCTTCAGCTCAATCATTTATTGAACGCATGACAAACTTTGATAAA
AATCTTCCAAATGAAAAGTACTACCAAAACATAGTTTGCTTTATGAGTA
TTTTACGGTTTATAACGAATTGACAAAGGTCAAATATGTTACTGAAGGAA
TGCGAAAACCAGCATTTCTTTCAGGTGAACAGAAGAAAGCCATTGTTGAT
TTACTCTTCAAAACAAATCGAAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGTACCTACCATGATTTGCTAAAAATT
ATTAAAGATAAAGATTTTTTGGATAATGAAGAAAATGAAGATATCTTAGA
GGATATTGTTTTAACATTGACCTTATTTGAAGATAGGGAGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGACATTCAAAAAGCACAAGTGTCTGGACAAGG
CGATAGTTTACATGAACATATTGCAAATTTAGCTGGTAGCCCTGCTATTA
AAAAAGGTATTTTACAGACTGTAAAAGTTGTTGATGAATTGGTCAAAGTA
ATGGGGCGGCATAAGCCAGAAAATATCGTTATTGAAATGGCACGTGAAAA

-continued
```
TCAGACAACTCAAAAGGGCCAGAAAAATTCGCGAGAGCGTATGAAACGAA
TCGAAGAAGGTATCAAAGAATTAGGAAGTCAGATTCTTAAAGAGCATCCT
GTTGAAAATACTCAATTGCAAAATGAAAAGCTCTATCTCTATTATCTCCA
AAATGGAAGAGACATGTATGTGGACCAAGAATTAGATATTAATCGTTTAA
GTGATTATGATGTCGATCACATTGTTCCACAAAGTTTCCTTAAAGACGAT
TCAATAGACAATAAGGTCTTAACGCGTTCTGATAAAAATCGTGGTAAATC
GGATAACGTTCCAAGTGAAGAAGTAGTCAAAAAGATGAAAAACTATTGGA
GACAACTTCTAAACGCCAAGTTAATCACTCAACGTAAGTTTGATAATTTA
ACGAAAGCTGAACGTGGAGGTTTGAGTGAACTTGATAAAGCTGGTTTTAT
CAAACGCCAATTGGTTGAAACTCGCCAAATCACTAAGCATGTGGCACAAA
TTTTGGATAGTCGCATGAATACTAAATACGATGAAAATGATAAACTTATT
CGAGAGGTTAAAGTGATTACCTTAAAATCTAAATTAGTTTCTGACTTCCG
AAAAGATTTCCAATTCTATAAAGTACGTGAGATTAACAATTACCATCATG
CCCATGATGCGTATCTAAATGCCGTCGTTGGAACTGCTTTGATTAAGAAA
TATCCAAAACTTGAATCGGAGTTTGTCTATGGTGATTATAAAGTTTATGA
TGTTCGTAAAATGATTGCTAAGTCTGAGCAAGAAATAGGCAAAGCAACCG
CAAAATATTTCTTTTACTCTAATATCATGAACTTCTTCAAAACAGAAATT
ACACTTGCAAATGGAGAGATTCGCAAACGCCCTCTAATCGAAACTAATGG
GGAAACTGGAGAAATTGTCTGGGATAAAGGGCGAGATTTTGCCACAGTGC
GCAAAGTATTGTCCATGCCCCAAGTCAATATTGTCAAGAAAACAGAAGTA
CAGACAGGCGGATTCTCCAAGGAGTCAATTTTACCAAAAAGAAATTCGGA
CAAGCTTATTGCTCGTAAAAAAGACTGGGATCCAAAAAAATATGGTGGTT
TTGATAGTCCAACGGTAGCTTATTCAGTCCTAGTGGTTGCTAAGGTGGAA
AAAGGGAAATCGAAGAAGTTAAAATCCGTTAAAGAGTTACTAGGGATCAC
AATTATGGAAAGAAGTTCCTTTGAAAAAAATCCGATTGACTTTTTAGAAG
CTAAAGGATATAAGGAAGTTAAAAAAGACTTAATCATTAAACTACCTAAA
TATAGTCTTTTTGAGTTAGAAAACGGTCGTAAACGGATGCTGGCTAGTGC
CGGAGAATTACAAAAAGGAAATGAGCTGGCTCTGCCAAGCAAATATGTGA
ATTTTTTATATTTAGCTAGTCATTATGAAAAGTTGAAGGGTAGTCCAGAA
GATAACGAACAAAAACAATTGTTTGTGGAGCAGCATAAGCATTATTTAGA
TGAGATTATTGAGCAAATCAGTGAATTTCTAAGCGTGTTATTTTAGCAG
ATGCCAATTTAGATAAAGTTCTTAGTGCATATAACAAACATAGAGACAAA
CCAATACGTGAACAAGCAGAAAATATTATTCATTTATTTACGTTGACAAA
TCTTGGAGCTCCCGCTGCTTTTAAATATTTTGATACAACAATTGATCGTA
AACGATATACGTCTACAAAAGAAGTTTTAGATGCCACTCTTATCCATCAA
TCCATCACTGGTCTTTATGAAACACGCATTGATTTGAGTCAGCTAGGAGG
TGACTGA
```
(SEQ ID NO: 52)
MDKK<u>YSIGLDIGTNSVGWAVITDEYKVPSKKFKVLGNTDRHSIKKNLIGA</u>
<u>LLFDSGET</u>AEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV</u>
<u>MGRHKPENIVIEMA</u>RENQTTQKGQKNSRERMKRIEEGIKELGSQILKEHP
<u>VENTQLQNEKLYLYYLQNGRDMYVDQELDINRLSDYDVDHIVPQSFLKDD</u>
<u>SIDNKVLTRSDKNRGKSDNVPSEEVVKKMKNYWRQLLNAKLITQRKFDNL</u>
<u>TKAERG</u>GLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD (single underline: HNH domain;
double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1); *Geobacillus stearothermophilus* (NCBI Ref: NZ_CP008934.1); or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation of SEQ ID NO: 52 or corresponding mutations in another Cas9. In some embodiments, the dCas9 comprises the amino acid sequence of SEQ ID NO: 53 dCas9 (D10A and H840A):

(SEQ ID NO: 53)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGAS QEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD (single underline: HNH domain;

double underline: RuvC domain).

In some embodiments, the Cas9 domain comprises a D10A mutation, while the residue at position 840 remains a histidine in the amino acid sequence provided in SEQ ID NO: 52, or at corresponding positions in any of the amino acid sequences provided in SEQ ID NOs: 108-357. Without wishing to be bound by any particular theory, the presence of the catalytic residue H840 maintains the activity of the Cas9 to cleave the non-edited (e.g., non-deaminated) strand containing a T opposite the targeted A. Restoration of H840 (e.g., from A840 of a dCas9) does not result in the cleavage of the target strand containing the A. Such Cas9 variants are able to generate a single-strand DNA break (nick) at a specific location based on the gRNA-defined target sequence, leading to repair of the non-edited strand, ultimately resulting in a T to C change on the non-edited strand. A schematic representation of this process is shown in FIG. 1C. Briefly, and without wishing to be bound by any particular theory, the A of a A-T base pair can be deaminated to a inosine (I) by an adenosine deaminase, e.g., an engineered adenosine deaminase that deaminates an adenosine in DNA. Nicking the non-edited strand, having the T, facilitates removal of the T via mismatch repair mechanisms. A UGI domain or a catalytically inactive inosine-specific nuclease (dISN) may inhibit inosine-specific nucleases (e.g., sterically) thereby preventing removal of the inosine (I).

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 53) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 53) are provided having amino acid sequences which are shorter, or longer than SEQ ID NO: 53, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Geobacillus stearothermophilus* (NCBI Ref: NZ_CP008934.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 34). In some embodiments, the Cas9 protein is a Cas9 nickase (nCas9). In some embodiments, the nCas9 comprises the amino acid sequence (SEQ ID NO: 35). In some embodiments, the Cas9 protein is a nuclease active Cas9. In some embodiments, the nuclease active Cas9 comprises the amino acid sequence (SEQ ID NO: 36).

Exemplary Catalytically Inactive Cas9 (dCas9):

(SEQ ID NO: 34)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary Cas9 Nickase (nCas9):

(SEQ ID NO: 35)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary Catalytically Active Cas9:

(SEQ ID NO: 36)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

-continued

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD.

In some embodiments, Cas9 refers to a Cas9 from arehaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 417-419. In some embodiments, the napDNAbp comprises an amino acid sequence of any one SEQ ID NOs: 417-419. It should be appreciated that CasX and CasY from other bacterial species may also be used in accordance with the present disclosure.

CasX (uniprot.org/uniprot/F0NN87; uniprot.org/uniprot/F0NH53)
>tr|F0NN87|F0NN87_SULIH CRISPR-associated
Casx protein OS = Sulfolobus islandicus
(strain HVE10/4) GN = SiH_0402 PE = 4 SV = 1
(SEQ ID NO: 417)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYEFGRSPGMVERTRRVKLE

VEPHYLIIAAAGWVLTRLGKAKVSEGDYVGVNVFTPTRGILYSLIQNVNG

IVPGIKPETAFGLWIARKVVSSVTNPNVSVVRIYTISDAVGQNPTTINGG

FSIDLTKLLEKRYLLSERLEAIARNALSISSNMRERYIVLANYIYEYLTG

SKRLEDLLYFANRDLIMNLNSDDGKVRDLKLISAYVNGELIRGEG

>tr|F0NH53|F0NH53_SULIR CRISPR associated
protein, Casx OS = Sulfolobus islandicus
(strain REY15A) GN = SiRe_0771 PE = 4 SV = 1
(SEQ ID NO: 418)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLTG

SKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY
[uncultured Parcubacteria group bacterium]
(SEQ ID NO: 419)
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPEKSAEEEGQRYLGIDIGEYGIAYTALEIT

GDSAKILDQNFISDPQLKTLREEVKGLKLDQRRGTFAMPSTKIARIRESL

-continued

VHSLRNRIHHLALKHKAKIVYELEVSRFEEGKQKIKKVYATLKKADVYSE

IDADKNLQTTVWGKLAVASEISASYTSQFCGACKKLWRAEMQVDETITTQ

ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI

The term "effective amount," as used herein, refers to an amount of a biologically active agent that is sufficient to elicit a desired biological response. For example, in some embodiments, an effective amount of a nucleobase editor may refer to the amount of the nucleobase editor that is sufficient to induce mutation of a target site specifically bound mutated by the nucleobase editor. In some embodiments, an effective amount of a fusion protein provided herein, e.g., of a fusion protein comprising a nucleic acid programmable DNA binding protein and a deaminase domain (e.g., an adenosine deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nucleobase editor, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "promoter" as used herein refers to a control region of a nucleic acid sequence at which initiation and rate of transcription of the remainder of a nucleic acid sequence are controlled. A promoter may also contain sub-regions to which regulatory proteins and molecules may bind, such as RNA polymerase and other transcription factors.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target), referred to as a guide sequence; and (2) a domain that binds a Cas9 protein. In some embodiments, domain (1) shares homology with a sequence in the promoter of the HBG1 and/or the HBG2 gene. In some embodiments, domain (1) shares homology with the sequence 5'-GTGGGGAAGGGGCCCC-CAAGAGG-3' (SEQ ID NO: 2). In some embodiments, domain (1) shares homology with a sequence in the HFE gene. In some embodiments, domain (1) shares homology with the sequence 5'-TATACGTACCAGGTG-GAGCACCCAGG-3' (SEQ ID NO: 3). In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); Mali, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al., RNA-programmed genome editing in human cells. eLife 2, e00471 (2013); Dicarlo, J. E. et al., Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-adenosine deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

DETAILED DESCRIPTION OF THE INVENTION

Some aspects of this disclosure relate to proteins that deaminate the nucleobase adenine. This disclosure provides adenosine deaminase proteins that are capable of deaminating (i.e., removing an amine group) adenine of a deoxyadenosine residue in deoxyribonucleic acid (DNA). For example, the adenosine deaminases provided herein are capable of deaminating adenine of a deoxyadenosine residue of DNA. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf1 protein) capable of binding to a specific nucleotide sequence. The deamination of an adenosine by an adenosine deaminase can lead to a point mutation, this process is referred to herein as nucleic acid editing. For example, the adenosine may be converted to an inosine residue, which typically base pairs with a cytosine residue. Such fusion proteins are useful inter alia for targeted editing of nucleic acid sequences. Such fusion proteins may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases that can be treated by making an A to G, or a T to C mutation, may be treated using the nucleobase editors provided herein. Without wishing to be bound by any particular theory certain anemias, such as sickle cell anemia, may be treated by inducing expression of hemoglobin, such as fetal hemoglobin, which is typically silenced in adults. As one example, mutating −198T to C in the promoter driving HBG1 and HB G2 gene expression results in increased expression of HBG1 and HBG2.

Another example, a class of disorders that results from a G to A mutation in a gene is iron storage disorders, where the HFE gene comprises a G to A mutation that results in expression of a C282Y mutant HFE protein. Thus, the adenosine base editors described herein may be utilized for the targeted editing of such G to A mutations (e.g., targeted genome editing). The invention provides deaminases, fusion proteins, nucleic acids, vectors, cells, compositions, methods, kits, systems, etc. that utilize the deaminases and nucleobase editors.

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein may comprise a Cas9 domain that has reduced nuclease activity. In some embodiments, the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand.

Adenosine Deaminases

Some aspects of the disclosure provide adenosine deaminases. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, 802-805, or to any of the adenosine deaminases provided herein. It should be appreciated that adenosine deaminases provided herein may include one or more mutations (e.g., any of the mutations provided herein). The disclosure provides any deaminase domains with a certain percent identiy plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 1, 64-84, 420-437, 672-684, 802-805, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 1, 64-84, 420-437, 672-684, 802-805, or any of the adenosine deaminases provided herein.

In some embodiments, the adenosine deaminase comprises a D108X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 1, or a corresponding mutation in another adenosine deaminase. In some embodiments, the adenosine deaminase comprises a D108N mutation in SEQ ID NO: 1, or a corresponding mutation in another adenosine deaminase. It should be appreciated, however, that additional deaminases may similarly be aligned to identify homologous amino acid residues that can be mutated as provided herein.

In some embodiments, the adenosine deaminse comprises an A106X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 1, or a corresponding mutation in another adenosine deaminase.

In some embodiments, the adenosine deaminase comprises a E155X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 1, or a corresponding mutation in another adenosine deaminase. In some embodiments, the adenosine deaminase comprises a E155V mutation in SEQ ID NO: 1, or a corresponding mutation in another adenosine deaminase.

In some embodiments, the adenosine deaminase comprises a D147X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a D147Y mutation in SEQ ID NO: 1, or a corresponding mutation in another adenosine deaminase.

It should be appreciated that any of the mutations provided herein (e.g., based on the ecTadA amino acid sequence of SEQ ID NO: 1) may be introduced into other adenosine deaminases, such as *S. aureus* TadA (saTadA), or other adenosine deaminases (e.g., bacterial adenosine deaminases). It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 1, or a corresponding mutation in another adenosine deaminase. In some embodiments, an adenosine deaminase comprises the following group of mutations (groups of mutations are separated by a ";") in ecTadA SEQ ID NO: 1, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA). In some embodiments, an adenosine deaminase comprises one or more of the mutations shown in FIG. 7, which identifies individual mutations and combinations of mutations made in ecTadA. In some embodiments, an adenosine deaminase comprises any mutation or combination of mutations provided herein.

In some embodiments, the adenosine deaminse comprises an L84X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an L84F mutation in SEQ ID NO: 1, or a corresponding mutation in another adenosine deaminase.

In some embodiments, the adenosine deaminse comprises an H123X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 1, or a corresponding mutation in another adenosine deaminase.

In some embodiments, the adenosine deaminse comprises an I156X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an I156F mutation in SEQ ID NO: 1, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in SEQ ID NO: 1, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, A106T, D108N, N127S, and K160S in SEQ ID NO: 1, or a corresponding mutation or mutations in another adenosine deaminase.

In some embodiments, the adenosine deaminse comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 1, or a corresponding mutation in another adenosine deaminase. In some embodiments, the adenosine deaminase comprises an A142N mutation in SEQ ID NO: 1, or a corresponding mutation in another adenosine deaminase.

In some embodiments, the adenosine deaminse comprises an H36X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 1, or a corresponding mutation in another adenosine deaminase.

In some embodiments, the adenosine deaminse comprises an N37X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 1, or a corresponding mutation in another adenosine deaminase. In some embodiments, the adenosine deaminase comprises a N37S mutation in SEQ ID NO: 1, or a corresponding mutation in another adenosine deaminase.

In some embodiments, the adenosine deaminse comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an P48T, P48S, P48A, or P48L mutation in SEQ ID NO: 1, or a corresponding mutation in another adenosine deaminase. In some embodiments, the adenosine deaminase comprises a P48T mutation in SEQ ID NO: 1, or a corresponding mutation in another adenosine deaminase. In some embodiments, the adenosine deaminase comprises a P48S mutation in SEQ ID NO: 1, or a corresponding mutation in another adenosine deaminase. In some embodiments, the adenosine deaminase comprises a P48A mutation in SEQ ID NO: 1, or a corresponding mutation in another adenosine deaminase.

In some embodiments, the adenosine deaminse comprises an R51X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 1, or a corresponding mutation in another adenosine deaminase. In some embodiments, the adenosine deaminase comprises a R51L mutation in SEQ ID NO: 1, or a corresponding mutation in another adenosine deaminase.

In some embodiments, the adenosine deaminse comprises an S146X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an S146R, or S146C mutation in SEQ ID NO: 1, or a corresponding mutation in another adenosine deaminase. In some embodiments, the adenosine deaminase comprises a S146C mutation in SEQ ID NO: 1, or a corresponding mutation in another adenosine deaminase.

In some embodiments, the adenosine deaminse comprises an K157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 1, or a corresponding mutation in another adenosine deaminase.

In some embodiments, the adenosine deaminase comprises an W23X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 1, or a corresponding mutation in another adenosine deaminase. In some embodiments, the adenosine deaminase comprises a W23R mutation in SEQ ID NO: 1, or a corresponding mutation in another adenosine deaminase. In some embodiments, the adenosine deaminase comprises a W23L mutation in SEQ ID NO: 1, or a corresponding mutation in another adenosine deaminase.

In some embodiments, the adenosine deaminse comprises an R152X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 1, or a corresponding mutation in another adenosine deaminase. In some embodiments, the adenosine deaminase comprises a R152P mutation in SEQ ID NO: 1, or a corresponding mutation in another adenosine deaminase. In some embodiments, the adenosine deaminase comprises a R152H mutation in SEQ ID NO: 1, or a corresponding mutation in another adenosine deaminase.

In some embodiments, the adenosine deaminse comprises an R26X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R26G mutation in SEQ ID NO: 1, or a corresponding mutation in another adenosine deaminase.

In some embodiments, the adenosine deaminse comprises an I49X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a I49V mutation in SEQ ID NO: 1, or a corresponding mutation in another adenosine deaminase.

In some embodiments, the adenosine deaminse comprises an N72X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a N72D mutation in SEQ ID NO: 1, or a corresponding mutation in another adenosine deaminase.

In some embodiments, the adenosine deaminase comprises an S97X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a S97C mutation in SEQ ID NO: 1, or a corresponding mutation in another adenosine deaminase.

In some embodiments, the adenosine deaminse comprises an G125X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a G125A mutation in SEQ ID NO: 1, or a corresponding mutation in another adenosine deaminase.

In some embodiments, the adenosine deaminse comprises an K161X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K161T mutation in SEQ ID NO: 1, or a corresponding mutation in another adenosine deaminase.

In some embodiments, the adenosine deaminase comprises one or more of a W23X, H36X, N37X, P48X, I49X, R51X, N72X, L84X, S97X, A106X, D108X, H123X, G125X, A142X, S146X, D147X, R152X, E155X, I156X, K157X, and/or K161X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of W23L, W23R, H36L, P48S, P48A, R51L, L84F, A106V, D108N, H123Y, A142N, S146C, D147Y, R152P, E155V, I156F, and/or K157N mutation in SEQ ID NO: 1, or one or more corresponding mutations in another adenosine deaminase. In some embodiments, the adenosine deaminase comprises one or more of the mutations provided in FIG. 7 corresponding to SEQ ID NO: 1, or one or more corresponding mutations in another adenosine deaminase.

In some embodiments, the adenosine deaminase comprises or consists of one or two mutations selected from A106X and D108X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one or two mutations selected from A106V and D108N in SEQ ID NO: 1, or a corresponding mutation or mutations in another adenosine deaminase.

In some embodiments, the adenosine deaminase comprises or consists of one, two, three, or four mutations selected from A106X, D108X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, or four mutations selected from A106V, D108N, D147Y, and E155V in SEQ ID NO: 1, or a corresponding mutation or mutations in another adenosine deaminase. In some embodiments, the adenosine deaminase comprises or consists of a A106V, D108N, D147Y, and E155V mutation in SEQ ID NO: 1, or corresponding mutations in another adenosine deaminase.

In some embodiments, the adenosine deaminase comprises or consists of one, two, three, four, five, six, or seven mutations selected from L84X, A106X, D108X, H123X, D147X, E155X, and I156X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, or seven mutations selected from L84F, A106V, D108N, H123Y, D147Y, E155V, and I156F in SEQ ID NO: 1, or a corresponding mutation or mutations in another adenosine deaminase. In some embodiments, the adenosine deaminase comprises or consists of a L84F, A106V, D108N, H123Y, D147Y, E155V, and I156F mutation in SEQ ID NO: 1, or corresponding mutations in another adenosine deaminase.

In some embodiments, the adenosine deaminase comprises or consists of one, two, three, four, five, six, seven, eight, nine, ten, or eleven mutations selected from H36X, R51X, L84X, A106X, D108X, H123X, S146X, D147X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, or eleven mutations selected from H36L, R51L, L84F, A106V, D108N, H123Y, S146C, D147Y, E155V, I156F, and K157N in SEQ ID NO: 1, or a corresponding mutation or mutations in another adenosine deaminase. In some embodiments, the adenosine deaminase comprises or consists of a H36L, R51L, L84F, A106V, D108N, H123Y, S146C, D147Y, E155V, I156F, and K157N mutation in SEQ ID NO: 1, or corresponding mutations in another adenosine deaminase.

In some embodiments, the adenosine deaminase comprises or consists of one, two, three, four, five, six, seven, eight, nine, ten, eleven, or twelve mutations selected from H36X, P48X, R51X, L84X, A106X, D108X, H123X, S146X, D147X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, or twelve mutations selected from H36L, P48S, R51L, L84F, A106V, D108N, H123Y, S146C, D147Y, E155V, I156F, and K157N in SEQ ID NO: 1, or a corresponding mutation or mutations in another adenosine deaminase. In some embodiments, the adenosine deaminse comprises or consists of a H36L, P48S, R51L, L84F, A106V, D108N, H123Y, S146C, D147Y, E155V, I156F, and K157N mutation in SEQ ID NO: 1, or corresponding mutations in another adenosine deaminase.

In some embodiments, the adenosine deaminase comprises or consists of one, two, three, four, five, six, seven, eight, nine, ten, eleven, twelve, or thirteen mutations selected from H36X, P48X, R51X, L84X, A106X, D108X, H123X, A142X, S146X, D147X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, or thirteen mutations selected from H36L, P48S, R51L, L84F, A106V, D108N, H123Y, A142N, S146C, D147Y, E155V, I156F, and K157N in SEQ ID NO: 1, or a corresponding mutation or mutations in another adenosine deaminase. In some embodiments, the adenosine deaminase comprises or consists of a H36L, P48S, R51L, L84F, A106V, D108N, H123Y, A142N, S146C, D147Y, E155V, I156F, and K157N mutation in SEQ ID NO: 1, or corresponding mutations in another adenosine deaminase.

In some embodiments, the adenosine deaminase comprises or consists of one, two, three, four, five, six, seven, eight, nine, ten, eleven, twelve, thirteen, or fourteen mutations selected from W23X, H36X, P48X, R51X, L84X, A106X, D108X, H123X, A142X, S146X, D147X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, or fourteen mutations selected from W23L, H36L, P48A, R51L, L84F, A106V, D108N, H123Y, A142N, S146C, D147Y, E155V, I156F, and K157N in SEQ ID NO: 1, or a corresponding mutation or mutations in another adenosine deaminase. In some embodiments, the adenosine deaminase comprises or consists of a W23L, H36L, P48A, R51L, L84F, A106V, D108N, H123Y, A142N, S146C, D147Y, E155V, I156F, and K157N mutation in SEQ ID NO: 1, or corresponding mutations in another adenosine deaminase.

In some embodiments, the adenosine deaminase comprises or consists of one, two, three, four, five, six, seven, eight, nine, ten, eleven, twelve, thirteen, or fourteen mutations selected from W23X, H36X, P48X, R51X, L84X, A106X, D108X, H123X, S146X, D147X, R152X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, or fourteen mutations selected from W23R, H36L, P48A, R51L, L84F, A106V, D108N, H123Y, S146C, D147Y, R152P, E155V, I156F, and K157N in SEQ ID NO: 1, or a corresponding mutation or mutations in another adenosine deaminase. In some embodiments, the adenosine deamise comprises or consists of a W23R, H36L, P48A, R51L, L84F, A106V, D108N, H123Y, S146C, D147Y, R152P, E155V, I156F, and K157N mutation in SEQ ID NO: 1, or corresponding mutations in another adenosine deaminase.

In some embodiments, the adenosine deaminase comprises or consists of one, two, three, four, five, six, seven, eight, nine, ten, eleven, twelve, thirteen, fourteen, or fifteen mutations selected from W23X, H36X, P48X, R51X, L84X, A106X, D108X, H123X, A142X, S146X, D147X, R152X, E155X, I156X, and K157X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises or consists of one, two, three, four, five, six, seven, eight, nine, ten, eleven, twelve, thirteen, fourteen, or fifteen mutations selected from W23L, H36L, P48A, R51L, L84F, A106V, D108N, H123Y, A142N, S146C, D147Y, R152P, E155V, I156F, and K157N in SEQ ID NO: 1, or a corresponding mutation or mutations in another adenosine deaminase. In some embodiments, the adenosine deaminase comprises or consists of a W23L, H36L, P48A, R51L, L84F, A106V, D108N, H123Y, A142N, S146C, D147Y, R152P, E155V, I156F, and K157N mutation in SEQ ID NO: 1, or corresponding mutations in another adenosine deaminase.

In some embodiments, the adenosine deaminase comprises one or more of the mutations provided in FIG. 7 corresponding to SEQ ID NO: 1, or one or more of the corresponding mutations in another deaminase. In some embodiments, the adenosine deaminase comprises or consists of a variant of SEQ ID NO: 1 provided in FIG. 7, or the corresponding variant in another adenosine deaminse.

It should be appreciated that the adenosine deaminase (e.g., a first or second adenosine deaminase) may comprise one or more of the mutations provided in any of the adenosine deaminases (e.g., ecTadA adenosine deaminases) shown in FIG. 7. In some embodiments, the adenosine deaminase comprises the combination of mutations of any of the adenosine deaminases (e.g., ecTadA adenosine deaminases) shown in FIG. 7. For example, the adenosine deaminase may comprise the mutations W23R, H36L, P48A, R51L, L84F, A106V, D108N, H123Y, S146C, D147Y, R152P, E155V, I156F, and K157N (relative to SEQ ID NO: 1), which is shown as ABE7.10 in FIG. 7. In some embodiments, the adenosine deaminase may comprise the mutations H36L, R51L, L84F, A106V, D108N, H123Y, S146C, D147Y, E155V, I156F, and K157N (relative to SEQ ID NO: 1). In some embodiments, the adenosine deaminase comprises any of the following combination of mutations relative to SEQ ID NO:1, where each mutation of a combination is separated by a "_" and each combination of mutations is between parentheses: (A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H), (A106V_D108N_D147Y_E155V), (D108Q_D147Y_E155V), (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D103A_D104N), (G22P_D103A_D104N_S138A), (D103A_D104N_S138A), (R26G_L84F_A106V_R107H_D108N_H123Y_A142N_A143D_D147Y_E155V_I156F), (E25G_R26G_L84F_A106V_R107H_D108N_H123Y_A142N_A143D_D147Y_E155V_I156F), (E25D_R26G_L84F_A106V_R107K_D108N_H123Y_A142N_A143G_D147Y_E155V_I156F), (R26Q_L84F_A106V_D108N_H123Y_A142N_D147Y_E155V_I156F), (E25M_R26G_L84F_A106V_R107P_D108N_H123Y_A142N_A143D_D147Y_E155V_I156F), (R26C_L84F_A106V_R107H_D108N_H123Y_A142N_D147Y_E155V_I156F), (L84F_A106V_D108N_H123Y_A142N_A143L_D147Y_E155V_I156F), (R26G_L84F_A106V_D108N_H123Y_A142N_D147Y_E155V_I156F), (E25A_R26G_L84F_A106V_R107N_D108N_H123Y_A142N_A143E_D147Y_E155V_I156F), (R26G_L84F_A106V_R107H_D108N_H123Y_A142N_A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_D147Y_E155V), (R26G_A106V_D108N_R107H_A142N_A143D_D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S146C_D147Y_E155V_I156F_K157N), (H36L_P48S_R51L_L84F_A106V_D108N_H123Y_S146C_D147Y_E155V_I156F_K157N), (H36L_P48S_R51L_L84F_A106V_D108N_H123Y_A142N_S146C_D147Y_E155V_I156F_K157N), (W23L_H36L_P48A_R51L_L84F_A106V_D108N_H123Y_A142N_S146C_D147Y_E155V_I156F_K157N), (W23L_H36L_P48A_R51L_L84F_A106V_D108N_H123Y_A142N_S146C_D147Y_R152P_E155V_I156F_K157N), (N37T_P48T_M70L_L84F_A106V_D108N_H123Y_D147Y_I49V_E155V_I156F), (N37S_L84F_A106V_D108N_H123Y_D147Y_E155V_I156F_K161T), (H36L_L84F_A106V_D108N_H123Y_D147Y_Q154H_E155V_I156F), (N72S_L84F_A106V_D108N_H123Y_S146R_D147Y_E155V_I156F), (H36L_P48L_L84F_A106V_D108N_H123Y_E134G_D147Y_E155V_I156F), (H36L_L84F_A106V_D108N_H123Y_D147Y_E155V_I156F_K157N), (H36L_L84F_A106V_D108N_H123Y_S146C_D147Y_E155V_I156F), (L84F_A106V_D108N_H123Y_S146R_

D147Y_E155V_I156F_K161T), (N37S_R51H_D77G_L84F_A106V_D108N_H123Y_D147Y_E155V_I156F), (R51L_L84F_A106V_D108N_H123Y_D147Y_E155V_I156F_K157N), (D24G_Q71R_L84F_H96L_A106V_D108N_H123Y_D147Y_E155V_I156F_K160E), (H36L_G67V_L84F_A106V_D108N_H123Y_S146T_D147Y_E155V_I156F), (Q71L_L84F_A106V_D108N_H123Y_L137M_A143E_D147Y_E155V_I156F), (E25G_L84F_A106V_D108N_H123Y_D147Y_E155V_I156F_Q159L), (L84F_A91T_F104I_A106V_D108N_H123Y_D147Y_E155V_I156F), (N72D_L84F_A106V_D108N_H123Y_G125A_D147Y_E155V_I156F), (P48S_L84F_S97C_A106V_D108N_H123Y_D147Y_E155V_I156F), (W23G_L84F_A106V_D108N_H123Y_D147Y_E155V_I156F), (D24G_P48L_Q71R_L84F_A106V_D108N_H123Y_D147Y_E155V_I156F_Q159L), (L84F_A106V_D108N_H123Y_A142N_D147Y_E155V_I156F), (H36L_R51L_L84F_A106V_D108N_H123Y_A142N_S146C_D147Y_E155V_I156F_K157N), (N37S_L84F_A106V_D108N_H123Y_A142N_D147Y_E155V_I156F_K161T), (L84F_A106V_D108N_D147Y_E155V_I156F), (R51L_L84F_A106V_D108N_H123Y_S146C_D147Y_E155V_I156F_K157N_K161T), (L84F_A106V_D108N_H123Y_S146C_D147Y_E155V_I156F_K161T), (L84F_A106V_D108N_H123Y_S146C_D147Y_E155V_I156F_K157N_K160E_K161T), (L84F_A106V_D108N_H123Y_S146C_D147Y_E155V_I156F_K157N_K160E), (R74Q_L84F_A106V_D108N_H123Y_D147Y_E155V_I156F), (R74A_L84F_A106V_D108N_H123Y_D147Y_E155V_I156F), (L84F_A106V_D108N_H123Y_D147Y_E155V_I156F), (R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_I156F), (P48S_L84F_A106V_D108N_H123Y_A142N_D147Y_E155V_I156F), (P48S_A142N), (P48T_I49V_L84F_A106V_D108N_H123Y_A142N_D147Y_E155V_I156F_L157N), (P48T_I49V_A142N), (H36L_P48S_R51L_L84F_A106V_D108N_H123Y_S146C_D147Y_E155V_I156F_K157N), (H36L_P48S_R51L_L84F_A106V_D108N_H123Y_S146C_A142N_D147Y_E155V_I156F_K157N), (H36L_P48T_I49V_R51L_L84F_A106V_D108N_H123Y_S146C_D147Y_E155V_I156F_K157N), (H36L_P48T_I49V_R51L_L84F_A106V_D108N_H123Y_A142N_S146C_D147Y_E155V_I156F_K157N), (H36L_P48A_R51L_L84F_A106V_D108N_H123Y_S146C_D147Y_E155V_I156F_K157N), (H36L_P48A_R51L_L84F_A106V_D108N_H123Y_A142N_S146C_D147Y_E155V_I156F_K157N), (H36L_P48A_R51L_L84F_A106V_D108N_H123Y_S146C_A142N_D147Y_E155V_I156F_K157N), (W23L_H36L_P48A_R51L_L84F_A106V_D108N_H123Y_S146C_D147Y_E155V_I156F_K157N), (W23R_H36L_P48A_R51L_L84F_A106V_D108N_H123Y_S146C_D147Y_E155V_I156F_K157N), (W23L_H36L_P48A_R51L_L84F_A106V_D108N_H123Y_S146R_D147Y_E155V_I156F_K161T), (H36L_P48A_R51L_L84F_A106V_D108N_H123Y_S146C_D147Y_R152H_E155V_I156F_K157N), (H36L_P48A_R51L_L84F_A106V_D108N_H123Y_S146C_D147Y_R152P_E155V_I156F_K157N), (W23L_H36L_P48A_R51L_L84F_A106V_D108N_H123Y_S146C_D147Y_R152P_E155V_I156F_K157N), (W23L_H36L_P48A_R51L_L84F_A106V_D108N_H123Y_A142A_S146C_D147Y_E155V_I156F_K157N), (W23L_H36L_P48A_R51L_L84F_A106V_D108N_H123Y_A142A_S146C_D147Y_R152P_E155V_I156F_K157N), (W23L_H36L_P48A_R51L_L84F_A106V_D108N_H123Y_S146R_D147Y_E155V_I156F_K161T), (W23R_H36L_P48A_R51L_L84F_A106V_D108N_H1-23Y_S146C_D147Y_R152P_E155V_I156F_K157N), (H36L_P48A_R51L_L84F_A106V_D108N_H123Y_A142N_S146C_D147Y_R152P_E155V_I156F_K157N).

In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 1, 64-84, 420-437, 672-684, 802-805, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NOs: 1, 64-84, 420-437, 672-684, 802-805, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NOs: 1, 64-84, 420-437, 672-684, 802-805, or any of the adenosine deaminases provided herein. In some embodiments, the adenosine deaminase comprises the amino acid sequence of any one of SEQ ID NOs: 1, 64-84, 420-437, 672-684, 802-805, or any of the adenosine deaminases provided herein. In some embodiments, the adenosine deaminase consists of the amino acid sequence of any one of SEQ ID NOs: 1, 64-84, 420-437, 672-684, 802-805, or any of the adenosine deaminases provided herein. The ecTadA sequences provided below are from ecTadA (SEQ ID NO: 1), absent the N-terminal methionine (M). The saTadA sequences provided below are from saTadA (SEQ ID NO: 8), absent the N-terminal methionine (M). For clarity, the amino acid numbering scheme used to identify the various amino acid mutations is derived from ecTadA (SEQ ID NO: 1) for *E. coli* TadA and saTadA (SEQ ID NO: 8) for *S. aureus* TadA. Amino acid mutations, relative to SEQ ID NO: 1 (ecTadA) or SEQ ID NO: 8 (saTadA), are indicated by underlining.

```
ecTadA
                                         (SEQ ID NO: 64)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (D108N)
                                         (SEQ ID NO: 65)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARNAKTGAAGSLMDVLHHPGMNHRVEITEGILADECAALLSDFFRM

RRQEIKAQKKAQSSTD
``` ecTadA (D108G)
(SEQ ID NO: 66)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARGAKTGAAGSLMDVLHHPGMNHRVEITEGILADECAALLSDFFRM

RRQEIKAQKKAQSSTD ecTadA (D108V)
(SEQ ID NO: 67)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARVAKTGAAGSLMDVLHHPGMNHRVEITEGILADECAALLSDFFRM

RRQEIKAQKKAQSSTD ecTadA (H8Y, D108N, and N127S)
(SEQ ID NO: 68)
SEVEFSYEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARNAKTGAAGSLMDVLHHPGMSHRVEITEGILADECAALLSDFFRM

RRQEIKAQKKAQSSTD ecTadA (H8Y, D108N, N127S, and E155D)
(SEQ ID NO: 69)
SEVEFSYEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARNAKTGAAGSLMDVLHHPGMSHRVEITEGILADECAALLSDFFRM

RRQDIKAQKKAQSSTD ecTadA (H8Y, D108N, N127S, and E155G)
(SEQ ID NO: 70)
SEVEFSYEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARNAKTGAAGSLMDVLHHPGMSHRVEITEGILADECAALLSDFFRM

RRQGIKAQKKAQSSTD ecTadA (H8Y, D108N, N127S, and E155V)
(SEQ ID NO: 71)
SEVEFSYEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARNAKTGAAGSLMDVLHHPGMSHRVEITEGILADECAALLSDFFRM

RRQVIKAQKKAQSSTD ecTadA (A106V, D108N, D147Y, and E155V)
(SEQ ID NO: 72)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGVRNAKTGAAGSLMDVLHHPGMNHRVEITEGILADECAALLSYFFRM

RRQVIKAQKKAQSSTD ecTadA (L84F, A106V, D108N, H123Y, D147Y, E155V, I156F)
(SEQ ID NO: 73)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (S2A, I49F, A106V, D108N, D147Y, E155V)
(SEQ ID NO: 74)
AEVEFSHEYWMRHALTLAKRAWDEREVPVGAVLVHNNRVIGEGWNRPFGR

HDPTAHAEIMALRQGGLVMQNYRLIDATLYVTLEPCVMCAGAMIHSRIGR

VVFGVRNAKTGAAGSLMDVLHHPGMNHRVEITEGILADECAALLSYFFRM

RRQVIKAQKKAQSSTD ecTadA (H8Y, A106T, D108N, N127S, K160S)
(SEQ ID NO: 75)
SEVEFSYEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGTRNAKTGAAGSLMDVLHHPGMSHRVEITEGILADECAALLSDFFRM

RRQEIKAQSKAQSSTD ecTadA (R26G, L84F, A106V, R107H, D108N, H123Y, A142N, A143D, D147Y, E155V, I156F)
(SEQ ID NO: 76)
SEVEFSHEYWMRHALTLAKRAWDEGEVPVGAVLVHNNRVIGEGWNRPIGR

HDPTAHAEIMALRQGGLVMQNYRLIDATLYVTFEPCVMCAGAMIHSRIGR

VVFGVHNAKTGAAGSLMDVLHYPGMNHRVEITEGILADECNDLLSYFFRM

RRQVFKAQKKAQSSTD ecTadA (E25G, R26G, L84F, A106V, R107H, D108N, H123Y, A142N, A143D, D147Y, E155V, I156F)
(SEQ ID NO: 77)
SEVEFSHEYWMRHALTLAKRAWDGGEVPVGAVLVHNNRVIGEGWNRPIGR

HDPTAHAEIMALRQGGLVMQNYRLIDATLYVTFEPCVMCAGAMIHSRIGR

VVFGVHNAKTGAAGSLMDVLHYPGMNHRVEITEGILADECNDLLSYFFRM

RRQVFKAQKKAQSSTD ecTadA (E25D, R26G, L84F, A106V, R107K, D108N, H123Y, A142N, A143G, D147Y, E155V, I156F)
(SEQ ID NO: 78)
SEVEFSHEYWMRHALTLAKRAWDDGEVPVGAVLVHNNRVIGEGWNRPIGR

HDPTAHAEIMALRQGGLVMQNYRLIDATLYVTFEPCVMCAGAMIHSRIGR

VVFGVKNAKTGAAGSLMDVLHYPGMNHRVEITEGILADECNGLLSYFFRM

RRQVFKAQKKAQSSTD ecTadA (R26Q, L84F, A106V, D108N, H123Y, A142N, D147Y, E155V, I156F)
(SEQ ID NO: 79)
SEVEFSHEYWMRHALTLAKRAWDEQEVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECNALLSYFFRM

RRQVFKAQKKAQSSTD ecTadA (E25M, R26G, L84F, A106V, R107P, D108N, H123Y, A142N, A143D, D147Y, E155V, I156F)
(SEQ ID NO: 80)
SEVEFSHEYWMRHALTLAKRAWDMGEVPVGAVLVHNNRVIGEGWNRPIGR

HDPTAHAEIMALRQGGLVMQNYRLIDATLYVTFEPCVMCAGAMIHSRIGR

-continued
VVFGVPNAKTGAAGSLMDVLHYPGMNHRVEITEGILADECNDLLSYFFRM

RRQVFKAQKKAQSSTD ecTadA (R26C, L84F, A106V, R107H, D108N, H123Y, A142N, D147Y, E155V, I156F)
(SEQ ID NO: 81)
SEVEFSHEYWMRHALTLAKRAWDECEVPVGAVLVHNNRVIGEGWNRPIGR

HDPTAHAEIMALRQGGLVMQNYRLIDATLYVTFEPCVMCAGAMIHSRIGR

VVFGVHNAKTGAAGSLMDVLHYPGMNHRVEITEGILADECNALLSYFFRM

RRQVFKAQKKAQSSTD ecTadA (L84F, A106V, D108N, H123Y, A142N, A143L, D147Y, E155V, I156F)
(SEQ ID NO: 82)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECNLLLSYFFRM

RRQVFKAQKKAQSSTD ecTadA (R26G, L84F, A106V, D108N, H123Y, A142N, D147Y, E155V, I156F)
(SEQ ID NO: 83)
SEVEFSHEYWMRHALTLAKRAWDEGEVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECNALLSYFFRM

RRQVFKAQKKAQSSTD ecTadA (E25A, R26G, L84F, A106V, R107N, D108N, H123Y, A142N, A143E, D147Y, E155V, I156F)
(SEQ ID NO: 420)
SEVEFSHEYWMRHALTLAKRAWDAGEVPVGAVLVHNNRVIGEGWNRPIGR

HDPTAHAEIMALRQGGLVMQNYRLIDATLYVTFEPCVMCAGAMIHSRIGR

VVFGVNNAKTGAAGSLMDVLHYPGMNHRVEITEGILADECNELLSYFFRM

RRQVFKAQKKAQSSTD ecTadA (L84F, A106V, D108N, H123Y, D147Y, E155V, I156F)
(SEQ ID NO: 421)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (N37T, P48T, L84F, A106V, D108N, H123Y, D147Y, E155V, I156F)
(SEQ ID NO: 422)
SEVEFSHEYWMRHALTLAKRAWDEREVPVGAVLVHTNRVIGEGWNRTIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (N37S, L84F, A106V, D108N, H123Y, D147Y, E155V, I156F)
(SEQ ID NO: 423)
SEVEFSHEYWMRHALTLAKRAWDEREVPVGAVLVHSNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (H36L, L84F, A106V, D108N, H123Y, D147Y, E155V, I156F)
(SEQ ID NO: 424)
SEVEFSHEYWMRHALTLAKRAWDEREVPVGAVLVLNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (L84F, A106V, D108N, H123Y, S146R, D147Y, E155V, I156F)
(SEQ ID NO: 425)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLRYFFRM

RRQVFKAQKKAQSSTD ecTadA (H36L, P48L, L84F, A106V, D108N, H123Y, D147Y, E155V, I156F)
(SEQ ID NO: 426)
SEVEFSHEYWMRHALTLAKRAWDEREVPVGAVLVLNNRVIGEGWNRLIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (H36L, L84F, A106V, D108N, H123Y, D147Y, E155V, K57N, I156F)
(SEQ ID NO: 427)
SEVEFSHEYWMRHALTLAKRAWDEREVPVGAVLVLNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFNAQKKAQSSTD ecTadA (H36L, L84F, A106V, D108N, H123Y, S146C, D147Y, E155V, I156F)
(SEQ ID NO: 428)
SEVEFSHEYWMRHALTLAKRAWDEREVPVGAVLVLNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

RRQVFKAQKKAQSSTD ecTadA (L84F, A106V, D108N, H123Y, S146R, D147Y, E155V, I156F)
(SEQ ID NO: 429)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLRYFFRM

RRQVFKAQKKAQSSTD ecTadA (N37S, R51H, L84F, A106V, D108N, H123Y, D147Y, E155V, I156F)
(SEQ ID NO: 430)
SEVEFSHEYWMRHALTLAKRAWDEREVPVGAVLVHSNRVIGEGWNRPIGH

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (R51L, L84F, A106V, D108N, H123Y,
D147Y, E155V, I156F, K157N)
(SEQ ID NO: 431)
SEVEFSHEYWMRHALTLAKRAWDEREVPVGAVLVHNNRVIGEGWNRPIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFNAQKKAQSSTD ecTadA (R51H, L84F, A106V, D108N, H123Y,
D147Y, E155V, I156F, K157N)
(SEQ ID NO: 432)
SEVEFSHEYWMRHALTLAKRAWDEREVPVGAVLVHNNRVIGEGWNRPIGH

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFNAQKKAQSSTD ecTadA (P48S)
(SEQ ID NO: 672)
SEVEFSHEYWMRHALTLAKRAWDEREVPVGAVLVHNNRVIGEGWNRSIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (P48T)
(SEQ ID NO: 673)
SEVEFSHEYWMRHALTLAKRAWDEREVPVGAVLVHNNRVIGEGWNRTIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (P48A)
(SEQ ID NO: 674)
SEVEFSHEYWMRHALTLAKRAWDEREVPVGAVLVHNNRVIGEGWNRAIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (A142N)
(SEQ ID NO: 675)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECNALLSDFFRM

RRQEIKAQKKAQSSTD ecTadA (W23R)
(SEQ ID NO: 676)
SEVEFSHEYWMRHALTLAKRARDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (W23L)
(SEQ ID NO: 677)
SEVEFSHEYWMRHALTLAKRALDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

RRQEIKAQKKAQSSTD ecTadA (R152P)
(SEQ ID NO: 678)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

PRQEIKAQKKAQSSTD ecTadA (R152H)
(SEQ ID NO: 679)
SEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGR

VVFGARDAKTGAAGSLMDVLHHPGMNHRVEITEGILADECAALLSDFFRM

HRQEIKAQKKAQSSTD ecTadA (L84F, A106V, D108N, H123Y, D147Y,
E155V, I156F)
(SEQ ID NO: 680)
SEVEFSHEYWMRHALTLAKRAWDEREVPVGAVLVHNNRVIGEGWNRPIGR

HDPTAHAEIMALRQGGLVMQNYRLIDATLYVTFEPCVMCAGAMIHSRIGR

VVFGVRNAKTGAAGSLMDVLHYPGMNHRVEITEGILADECAALLSYFFRM

RRQVFKAQKKAQSSTD ecTadA (H36L, R51L, L84F, A106V, D108N,
H123Y, S146C, D147Y, E155V, I156F, K157N)
(SEQ ID NO: 681)
SEVEFSHEYWMRHALTLAKRAWDEREVPVGAVLVLNNRVIGEGWNRPIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

RRQVFNAQKKAQSSTD ecTadA (H36L, P48S, R51L, L84F, A106V,
D108N, H123Y, S146C, D147Y, E155V, I156F,
K157N)
(SEQ ID NO: 682)
SEVEFSHEYWMRHALTLAKRAWDEREVPVGAVLVLNNRVIGEGWNRSIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

RRQVFNAQKKAQSSTD ecTadA (H36L, P48A, R51L, L84F, A106V,
D108N, H123Y, S146C, D147Y, E155V, I156F,
K157N)
(SEQ ID NO: 683)
SEVEFSHEYWMRHALTLAKRAWDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

RRQVFNAQKKAQSSTD ecTadA (W23L, H36L, P48A, R51L, L84F,
A106V, D108N, H123Y, S146C, D147Y, R152P,
E155V, I156F, K157N)
(SEQ ID NO: 684)
SEVEFSHEYWMRHALTLAKRALDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD ecTadA (H36L, P48S, R51L, L84F, A106V,
D108N, H123Y, A142N, S146C, D147Y, E155V,
I156F, K157N)
(SEQ ID NO: 802)
SEVEFSHEYWMRHALTLAKRAWDEREVPVGAVLVLNNRVIGEGWNRSIGL

HDPTAHAEIMALRQGGLVMQNYRLIDATLYVTFEPCVMCAGAMIHSRIGR

VVFGVRNAKTGAAGSLMDVLHYPGMNHRVEITEGILADECNALLCYFFRM

RRQVFNAQKKAQSSTD ecTadA (W23L, H36L, P48A, R51L, L84F,
A106V, D108N, H123Y, A142N, S146C, D147Y,
E155V, I156F, K157N)
(SEQ ID NO: 803)
SEVEFSHEYWMRHALTLAKRALDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECNALLCYFFRM

RRQVFNAQKKAQSSTD ecTadA (W23L, H36L, P48A, R51L, L84F,
A106V, D108N, H123Y, A142N, S146C, D147Y,
R152P, E155V, I156F, K157N)
(SEQ ID NO: 804)
SEVEFSHEYWMRHALTLAKRALDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECNALLCYFFRM

PRQVFNAQKKAQSSTD ecTadA (W23R, H36L, P48A, R51L, L84F,
A106V, D108N, H123Y, S146C, D147Y, R152P,
E155V, I156F, K157N)
(SEQ ID NO: 805)
SEVEFSHEYWMRHALTLAKRALDEREVPVGAVLVLNNRVIGEGWNRAIGL

HDPTAHAEIMALRQGGLVMQNYRLIDATLYVTFEPCVMCAGAMIHSRIGR

VVFGVRNAKTGAAGSLMDVLHYPGMNHRVEITEGILADECAALLCYFFRM

PRQVFNAQKKAQSSTD

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 108-357. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 108-357. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 52, or a corresponding mutation in any of the amino acid sequences provided in SEQ ID NOs: 108-357, wherein X is any amino acid change. In some embodiments, the nuclease-inactive dCas9 domain comprises a D10A mutation and a H840A mutation of the amino acid sequence set forth in SEQ ID NO: 52, or a corresponding mutation in any of the amino acid sequences provided in SEQ ID NOs: 108-357. As one example, a nuclease-inactive Cas9 domain comprises the amino acid sequence set forth in SEQ ID NO: 54 (Cloning vector pPlatTET-gRNA2, Accession No. BAV54124).

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

-continued
DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD(SEQ ID NO: 54; see, e.g., Qi et al., "Repurposing CRISPR as an RNA-guided platform for sequence-specific control of gene expression."

Cell. 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 52, or a mutation in any of SEQ ID NOs: 108-357. As one example, a Cas9 nickase may comprise the amino acid sequence as set forth in SEQ ID NO: 35. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 52, or a corresponding mutation in any of SEQ ID NOs: 108-357. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 55. In some embodiments, the SaCas9 comprises a N579X mutation of SEQ ID NO: 55, or a corresponding mutation in any of the amino acid sequences provided in SEQ ID NOs: 108-357, wherein X is any amino acid except for N. In some embodiments, the SaCas9 comprises a N579A mutation of SEQ ID NO: 55, or a corresponding mutation in any of the amino acid sequences provided in SEQ ID NOs: 108-357.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X mutation of SEQ ID NO: 55, or a corresponding mutation in any of the amino acid sequences provided in SEQ ID NOs: 108-357, wherein X is any amino acid. In some embodiments, the SaCas9 domain comprises one or more of a E781K, a N967K, and a R1014H mutation of SEQ ID NO: 55, or one or more corresponding mutation in any of the amino acid sequences provided in SEQ ID NOs: 108-357. In some embodiments, the SaCas9 domain comprises a E781K, a N967K, or a R1014H mutation of SEQ ID NO: 55, or corresponding mutations in any of the amino acid sequences provided in SEQ ID NOs: 108-357.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 55-57. In some embodiments, the Cas9 domain of any of the fusion proteins provided herein comprises the amino acid sequence of any one of SEQ ID NOs: 55-57. In some embodiments, the Cas9 domain of any of the fusion proteins provided herein consists of the amino acid sequence of any one of SEQ ID NOs: 55-57.

Exemplary SaCas9 Sequence (SEQ ID NO: 55)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 of SEQ ID NO: 55, which is underlined and in bold, may be mutated (e.g., to a A579) to yield a SaCas9 nickase.

Exemplary SaCas9n Sequence (SEQ ID NO: 56)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG.

Residue A579 of SEQ ID NO: 56, which can be mutated from N579 of SEQ ID NO: 55 to yield a SaCas9 nickase, is underlined and in bold.

Exemplary SaKKH Cas9

(SEQ ID NO: 57)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

-continued

```
ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

REYLENMNDKRPPHIIKTIASKTQSIKKYSTDILGNLYEVKSKKHPQIIK

KG.
```

Residue A579 of SEQ ID NO: 57, which can be mutated from N579 of SEQ ID NO: 55 to yield a SaCas9 nickase, is underlined and in bold. Residues K781, K967, and H1014 of SEQ ID NO: 57, which can be mutated from E781, N967, and R1014 of SEQ ID NO: 55 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 58. In some embodiments, the SpCas9 comprises a D9X mutation of SEQ ID NO: 58, or a corresponding mutation in any of the amino acid sequences provided in SEQ ID NOs: 108-357, wherein X is any amino acid except for D. In some embodiments, the SpCas9 comprises a D9A mutation of SEQ ID NO: 58, or a corresponding mutation in any of the amino acid sequences provided in SEQ ID NOs: 108-357. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134E, R1334Q, and T1336R mutation of SEQ ID NO: 58, or a corresponding mutation in any of the amino acid sequences provided in SEQ ID NOs: 108-35. In some embodiments, the SpCas9 domain comprises a D1134E, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a G1217X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a G1217R, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a G1217R, a R1334Q, and a T1336R mutation of SEQ ID NO: 58, or corresponding mutations in any of the amino acid sequences provided in SEQ ID NOs: 108-35.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 58-62. In some embodiments, the Cas9 domain of any of the fusion proteins provided herein comprises the amino acid sequence of any one of SEQ ID NOs: 58-62. In some embodiments, the Cas9 domain of any of the fusion proteins provided herein consists of the amino acid sequence of any one of SEQ ID NOs: 58-62.

Exemplary SpCas9

```
                                          (SEQ ID NO: 58)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY
```

SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD

Exemplary SpCas9n (SEQ ID NO: 59)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD Exemplary SpEQR Cas9

(SEQ ID NO: 60)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVETSGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFESPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKQYRSTKEVLDATLIHQS
ITGLYETRIDLSQLGGD

Residues E1134, Q1334, and R1336 of SEQ ID NO: 60, which can be mutated from D1134, R1334, and T1336 of SEQ ID NO: 58 to yield a SpEQR Cas9, are underlined and in bold.

Exemplary SpVQR Cas9

(SEQ ID NO: 61)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL

```
-continued
LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD
```

Residues V1134, Q1334, and R1336 of SEQ ID NO: 61, which can be mutated from D1134, R1334, and T1336 of SEQ ID NO: 58 to yield a SpVQR Cas9, are underlined and in bold.

Exemplary SpVRER Cas9

```
                                          (SEQ ID NO: 62)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD
```

Residues V1134, R1217, Q1334, and R1336 of SEQ ID NO: 62, which can be mutated from D1134, G1217, R1334, and T1336 of SEQ ID NO: 58 to yield a SpVRER Cas9, are underlined and in bold.

High Fidelity Cas9 Domains

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain (e.g., a wild type Cas9 domain) comprises one or more mutations that decreases the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, any of the Cas9 fusion proteins provided herein comprise one or more of N497X, R661X, Q695X, and/or Q926X mutation of the amino acid sequence provided in SEQ ID NO: 52, or a corresponding mutation in any of the amino acid sequences provided in SEQ ID NOs: 108-357, wherein X is any amino acid. In some embodiments, any of the Cas9 fusion proteins provided herein comprise one or more of N497A, R661A, Q695A, and/or Q926A mutation of the amino acid sequence provided in SEQ ID NO: 52, or a corresponding mutation in any of the amino acid sequences provided in SEQ ID NOs: 108-357. In some embodiments, the Cas9 domain comprises a D10A mutation of the amino acid sequence provided in SEQ ID NO: 52, or a corresponding mutation in any of the amino acid sequences provided in SEQ ID NOs: 108-357. In some embodiments, the Cas9 domain (e.g., of any of the fusion proteins provided herein) comprises the amino acid sequence as set forth in SEQ ID NO: 62. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that any of the base editors provided herein, for example, any of the adenosine deaminase base editors provided herein, may be converted into high fidelity base editors by modifying the Cas9 domain as described herein to generate high fidelity base editors, for example, a high fidelity adenosine base editor. In some embodiments, the high fidelity Cas9 domain is a dCas9 domain. In some embodiments, the high fidelity Cas9 domain is a nCas9 domain.

High Fidelity Cas9 Domain where Mutations Relative to Cas9 of SEQ ID NO: 10 are Shown in Bold and Underlines (SEQ ID NO: 63)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVETSGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Nucleic Acid Programmable DNA Binding Proteins

Some aspects of the disclosure provide nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2c1, C2c2, C2C3, and Argonaute. One example of an nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell*, 2015 Nov. 5; 60(3): 385-397, the entire contents of which is hereby incorporated by reference.

Fusion Proteins Comprising a Nuclease Programmable DNA Binding Protein and an Adenosine Deaminase Some aspects of the disclosure provide fusion proteins comprising a nucleic acid programmable DNA binding protein (napDNAbp) and an adenosine deaminase. In some embodiments, any of the fusion proteins provided herein are base editors. In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napD-NAbp is any napDNAbp provided herein. Some aspects of the disclosure provide fusion proteins comprising a Cas9 domain and an adenosine deaminase. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the fusion protein comprises the structure:

NH$_2$-[adenosine deaminase]-[napDNAbp]-COOH; or
NH$_2$-[napDNAbp]-[adenosine deaminase]-COOH In some embodiments, the fusion proteins comprising an adenosine deaminase and a napDNAbp (e.g., Cas9 domain) do not include a linker sequence. In some embodiments, a linker is present between the adenosine deaminase domain and the napDNAbp. In some embodiments, the "-" used in the general architecture above indicates the presence of an optional linker. In some embodiments, the adenosine deaminase and the napDNAbp are fused via any of the linkers provided herein. For example, in some embodiments the adenosine deaminase and the napDNAbp are fused via any of the linkers provided below in the section entitled "Linkers". In some embodiments, the adenosine deaminase and the napDNAbp are fused via a linker that comprises between 1 and and 200 amino acids. In some embodiments, the adenosine deaminase and the napDNAbp are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the napDNAbp are fused via a linker that comprises 3, 4, 16, 24, 32, 64, 100, or 104 amino acids in length. In some embodiments, the adenosine deaminase and the napDNAbp are fused via a linker that comprises the amino acid sequence of SGSETPGTSESATPES (SEQ ID NO: 10), SGGS (SEQ ID NO: 37), SGGSSGSETPGTSESATPESSGGS (SEQ ID NO: 384), SGGSSGGSSGSETPGTSESATPESSGGSSGGS (SEQ ID NO: 385), or GGSGGSPGSPAGSPTSTEEGTSESATPESGPGTSTE PSEGSAPGSPAGSPTSTEEGTSTE PSEGSAPGTSTE PSEGSAPGTSESATPESGPGSEPATSGGSGGS (SEQ ID NO: 386). In some embodiments, the adenosine deaminase and the napDNAbp are fused via a linker comprising the amino acid sequence SGSETPGTSESATPES (SEQ ID NO: 10), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 685). In some embodiments, the linker is 32 amino acids in length. In some embodiments, the linker comprises the amino acid sequence (SGGS)$_2$-SGSETPGTSESATPES-(SGGS)$_2$ (SEQ ID NO: 800), which may also be referred to as (SGGS)$_2$-XTEN-(SGGS)$_2$. In some embodiments, the linker comprises the amino acid sequence (SGGS)$_n$-SGSETPGTSESATPES-(SGGS)$_n$ (SEQ ID NO: 801), wherein n is 0, 1, 2, 3, 4, 5, 6, 7, 8, 9, or 10. In some embodiments, the linker is 40 amino acids in length. In some embodiments, the linker comprises the amino acid sequence SGGSSGGSSGSETPGTSESATPESSGGSSGGSSG GS SGGS (SEQ ID NO: 686). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGS SGGS (SEQ ID NO: 687). In some embodiments, the linker is 92 amino acids in length. In some embodiments, the linker comprises the amino acid sequence PGSPAGSPTSTEEGTSESATPESGPGTSTEPSEGSAP GSPAGSPTSTEEGTSTEPSEGSAP GTSTEPSEGSAPGTSESATPESGPGSEPATS (SEQ ID NO: 688).

Fusion Proteins Comprising a Nuclear Localization Sequence (NLS)

In some embodiments, the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the IBR (e.g., dISN). In some embodiments, the NLS is fused to the C-terminus of the IBR (e.g., dISN). In some embodiments, the NLS is fused to the N-terminus of the napDNAbp. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 4 or SEQ ID NO: 5. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 4), MDSLLMNRRKFLYQFKNVRWAKGRRETYLC (SEQ ID NO: 5), MKRTADGSEFEPKKKRKV (SEQ ID NO: 342), or KRTADGSEFEPKKKRKV (SEQ ID NO: 343).

In some embodiments, the general architecture of exemplary fusion proteins with an adenosine deaminase and a napDNAbp comprises any one of the following structures, where NLS is a nuclear localization sequence (e.g., any NLS provided herein), NH$_2$ is the N-terminus of the fusion protein, and COOH is the C-terminus of the fusion protein. Fusion proteins comprising an adenosine deaminase, a napDNAbp, and a NLS:

NH$_2$-[NLS]-[adenosine deaminase]-[napDNAbp]-COOH;

NH$_2$-[adenosine deaminase]-[NLS]-[napDNAbp]-COOH;

NH$_2$-[adenosine deaminase]-[napDNAbp]-[NLS]-COOH;

NH$_2$-[NLS]-[napDNAbp]-[adenosine deaminase]-COOH;

NH$_2$-[napDNAbp]-[NLS]-[adenosine deaminase]-COOH; and

NH$_2$-[napDNAbp]-[adenosine deaminase]-[NLS]-COOH.

In some embodiments, the fusion proteins provided herein do not comprise a linker. In some embodiments, a linker is present between one or more of the domains or proteins (e.g., adenosine deaminase, napDNAbp, and/or NLS). In some embodiments, the "-" used in the general architecture above indicates the presence of an optional linker.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 72, which contains a A106V, D108N, D147Y, and E155V mutation from ecTadA (SEQ ID NO: 1). In some embodiments, the fusion protein may comprise a first adenosine deaminase that comprises the amino acid sequence of SEQ ID NO: 682, which contains a H36L, P48S, R51L, L84F, A106V, D108N, H123Y, S146C, D147Y, E155V, I156F, and K157N mutation from SEQ ID NO: 1, and a second adenosine deaminase domain that comprises the amino amino acid sequence of wild-type ecTadA (SEQ ID NO: 1). In some embodiments, the fusion protein may comprise a first adenosine deaminase that comprises the amino acid sequence of SEQ ID NO: 802, which contains a H36L, P48S, R51L, L84F, A106V, D108N, H123Y, A142N, S146C, D147Y, E155V, I156F, and K157N mutation from SEQ ID NO: 1, and a second adenosine deaminase domain that comprises the amino amino acid sequence of wild-type ecTadA (SEQ ID NO: 1). In some embodiments, the fusion protein may comprise a first adenosine deaminase that comprises the amino acid sequence of SEQ ID NO: 803, which contains a W23L, H36L, P48A, R51L, L84F, A106V, D108N, H123Y, A142N, S146C, D147Y, E155V, I156F, and K157N mutation from SEQ ID NO: 1, and a second adenosine deaminase domain that comprises the amino amino acid sequence of wild-type ecTadA (SEQ ID NO: 1). In some embodiments, the fusion protein may comprise a first adenosine deaminase that comprises the amino acid sequence of SEQ ID NO: 804, which contains a W23L, H36L, P48A, R51L, L84F, A106V, D108N, H123Y, A142N, S146C, D147Y, R152P, E155V, I156F, and K157N mutation from SEQ ID NO: 1, and a second adenosine deaminase domain that comprises the amino amino acid sequence of wild-type ecTadA (SEQ ID NO: 1). In some embodiments, the fusion protein may comprise a first adenosine deaminase that comprises the amino acid sequence of SEQ ID NO: 805, which contains a W23R, H36L, P48A, R51L, L84F, A106V, D108N, H123Y, S146C, D147Y, R152P, E155V, I156F, and K157N mutation from SEQ ID NO: 1, and a second adenosine deaminase domain that comprises the amino amino acid sequence of wild-type ecTadA (SEQ ID NO: 1). Additional fusion protein constructs comprising two adenosine deaminase domains are illustrated in FIG. 7.

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the linker comprises the amino acid sequence of any one of SEQ ID NOs: 10, 37-40, 384-386, 685-688, or 800-801. In some embodiments, the linker is 32 amino acids in length. In some embodiments, the linker comprises the amino acid sequence (SGGS)$_2$-SGSETPGT-SESATPES-(SGGS)$_2$ (SEQ ID NO: 800), which may also be referred to as (SGGS)$_2$-XTEN-(SGGS)$_2$. In some embodiments, the linker comprises the amino acid sequence (SGGS)$_n$-SGSETPGTSESATPES-(SGGS)$_n$ (SEQ ID NO: 801), wherein n is 0, 1, 2, 3, 4, 5, 6, 7, 8, 9, or 10. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the first adenosine deaminase comprises the amino acid sequence of SEQ ID NO: 1. In some embodiments, the second adenosine deaminase comprises an amino acid sequence that is at least least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the second adenosine deaminase comprises the amino acid sequence of SEQ ID NO: 1. In some embodiments, the first adenosine deaminase and the second adenosine deaminase of the fusion protein comprise the mutations in ecTadA (SEQ ID NO: 1), or corresponding mutations in another adenosine deaminase, as shown in any one of the constructs provided in FIG. 19 (e.g., pNMG-371, pNMG-477, pNMG-576, pNMG-586, and pNMG-616). In some embodiments, the fusion protein comprises the two adenosine deaminases (e.g., a first adenosine deaminase and a second adenosine deaminase) of any one of the constructs (e.g., pNMG-371, pNMG-477, pNMG-576, pNMG-586, and pNMG-616) in FIG. 19.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), NH$_2$ is the N-terminus of the fusion protein, and COOH is the C-terminus of the fusion protein.

Fusion proteins comprising a first adenosine deaminase, a second adenosine deaminase, and a napDNAbp. NH$_2$-[first adenosine deaminase]-[second adenosine deaminase]-[napDNAbp]-COOH; NH$_2$-[first adenosine deaminase]-[napDNAbp]-[second adenosine deaminase]-COOH; NH$_2$-[napDNAbp]-[first adenosine deaminase]-[second adenosine deaminase]-COOH; NH$_2$-[second adenosine deaminase]-[first adenosine deaminase]-[napDNAbp]-COOH; NH$_2$-[second adenosine deaminase]-[napDNAbp]-[first adenosine deaminase]-COOH; NH$_2$-[napDNAbp]-[second adenosine deaminase]-[first adenosine deaminase]-COOH;

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "-" used in the general architecture above indicates the presence of an optional linker.

Fusion proteins comprising a first adenosine deaminase, a second adenosine deaminase, a napDNAbp, and an NLS. NH$_2$-[NLS]-[first adenosine deaminase]-[second adenosine deaminase]-[napDNAbp]-COOH; NH$_2$-[first adenosine deaminase]-[NLS]-[second adenosine deaminase]-[napDNAbp]-COOH; NH$_2$-[first adenosine deaminase]-[second adenosine deaminase]-[NLS]-[napDNAbp]-COOH; NH$_2$-[first adenosine deaminase]-[second adenosine deaminase]-[napDNAbp]-[NLS]-COOH; NH$_2$-[NLS]-[first adenosine deaminase]-[napDNAbp]-[second adenosine deaminase]-COOH; NH$_2$-[first adenosine deaminase]-[NLS]-[napDNAbp]-[second adenosine deaminase]-COOH; NH$_2$-[first adenosine deaminase]-[napDNAbp]-[NLS]-[second adenosine deaminase]-COOH; NH$_2$-[first adenosine deaminase]-[napDNAbp]-[second adenosine deaminase]-[NLS]-COOH; NH$_2$-[NLS]-[napDNAbp]-[first adenosine deaminase]-[second adenosine deaminase]-COOH; NH$_2$-[napDNAbp]-[NLS]-[first adenosine deaminase]-[second adenosine deaminase]-COOH; NH$_2$-[napDNAbp]-[first adenosine deaminase]-[NLS]-[second adenosine deaminase]-COOH; NH$_2$-[napDNAbp]-[first adenosine deaminase]-[second adenosine deaminase]-[NLS]-COOH; NH$_2$-[NLS]-[second adenosine deaminase]-[first adenosine deaminase]-[napDNAbp]-COOH; NH$_2$-[second adenosine deaminase]-[NLS]-[first adenosine deaminase]-[napDNAbp]-COOH; NH$_2$-[second adenosine deaminase]-[first adenosine deaminase]-[NLS]-[napDNAbp]-COOH; NH$_2$-[second adenosine deaminase]-[first adenosine deaminase]-[napDNAbp]-[NLS]-COOH; NH$_2$-[NLS]-[second adenosine deaminase]-[napDNAbp]-[first adenosine deaminase]-COOH; NH$_2$-[second adenosine deaminase]-[NLS]-[napDNAbp]-[first adenosine deaminase]-COOH; NH$_2$-[second adenosine deaminase]-[napDNAbp]-[NLS]-[first adenosine deaminase]-COOH; NH$_2$-[second adenosine deaminase]-[napDNAbp]-[first adenosine deaminase]-[NLS]-COOH; NH$_2$-[NLS]-[napDNAbp]-[second adenosine deaminase]-[first adenosine deaminase]-COOH; NH$_2$-[napDNAbp]-[NLS]-[second adenosine deaminase]-[first adenosine deaminase]-COOH; NH$_2$-[napDNAbp]-[second adenosine deaminase]-[NLS]-[first adenosine deaminase]-COOH; NH$_2$-[napDNAbp]-[second adenosine deaminase]-[first adenosine deaminase]-[NLS]-COOH;

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "-" used in the general architecture above indicates the presence of an optional linker.

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, the linker is 32 amino acids in length. In some embodiments, the linker comprises the amino acid sequence (SGGS)$_2$-SGSETPGTSESATPES-(SGGS)$_2$ (SEQ ID NO: 800), which may also be referred to as (SGGS)$_2$-XTEN-(SGGS)$_2$. In some embodiments, the linker comprises the amino acid sequence, wherein n is 0, 1, 2, 3, 4, 5, 6, 7, 8, 9, or 10. In some embodiments, a linker comprises the amino acid sequence SGGS (SEQ ID NO:

37). In some embodiments, a linker comprises (SGGS)$_n$ (SEQ ID NO: 37), (GGGS)$_n$ (SEQ ID NO: 38), (GGGGS)$_n$ (SEQ ID NO: 39), (G)$_n$, (EAAAK)$_n$ (SEQ ID NO: 40), (SGGS)$_n$-SGSETPGTSESATPES-(SGGS)$_n$ (SEQ ID NO: 801), (GGS)n, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 10), and SGGS (SEQ ID NO: 37). In some embodiments, a linker comprises SGGSSGSETPGTSESATPESSGGS (SEQ ID NO: 384). In some embodiments, a linker comprises SGGSSGGSSGSETPGTSESATPESSGGSSGGS (SEQ ID NO: 385). In some embodiments, a linker comprises GGSGGSPGSPAGSPTSTEEGTSESATPESGPGTSTEP-SEGSAPGSPAGSPTSTEEGTSTE PSEGSAPGT-STEPSEGSAPGTSESATPESGPGSEPATSGGSGGS (SEQ ID NO: 386). In some embodiments, the linker is 24 amino acids in length. In some embodiments, the linker comprises the amino acid sequence SGGSSGGSSGSETPGTSESAT-PES (SEQ ID NO: 685). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 686). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESATPES-SGGS SGGS (SEQ ID NO: 687). In some embodiments, the linker is 92 amino acids in length. In some embodiments, the linker comprises the amino acid sequence PGSPAGSPT-STEEGTSESATPESGPGTSTEPSEGSAPGSPAGSPT-STEEGTSTEPSEGSAP GTSTEPSEGSAPGTSESAT-PESGPGSEPATS (SEQ ID NO: 688). It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase), a nucleic acid programmable DNA binding protein (napDNAbp), and or an inhibitor of base repair (IBR). Various linker lengths and flexibilities between an adenosine deaminase (e.g., an engineered ecTadA) and a napDNAbp (e.g., a Cas9 domain), and/or between a first adenosine deaminase and a second adenosine deaminase can be employed (e.g., ranging from very flexible linkers of the form (GGGGS)$_n$ (SEQ ID NO: 38), (GGGGS)$_n$ (SEQ ID NO: 39), and (G)$_n$ to more rigid linkers of the form (EAAAK)$_n$ (SEQ ID NO: 40), (SGGS)$_n$ (SEQ ID NO: 37), SGSETPGTSESATPES (SEQ ID NO: 10) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP)$_n$) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising the amino acid sequence SGSETPGT-SESATPES (SEQ ID NO: 10), SGGS (SEQ ID NO: 37), SGGSSGSETPGTSESATPESSGGS (SEQ ID NO: 384), SGGSSGGSSGSETPGTSESATPESSGGSSGGS (SEQ ID NO: 385), or GGSGGSPGSPAGSPTSTEEGTSESATPE-SGPGTSTEPSEGSAPGSPAGSPTSTEEGTSTE PSEGS-APGTSTEPSEGSAPGTSESATPESGPGSEPATSGG-SGGS (SEQ ID NO: 386). In some embodiments, the linker is 24 amino acids in length. In some embodiments, the linker comprises the amino acid sequence SGGSSGGSSG-SETPGTSESATPES (SEQ ID NO: 685). In some embodiments, the linker is 32 amino acids in length. In some embodiments, the linker is 32 amino acids in length. In some embodiments, the linker comprises the amino acid sequence (SGGS)$_2$-SGSETPGTSESATPES-(SGGS)$_2$ (SEQ ID NO: 800), which may also be referred to as (SGGS)$_2$-XTEN-(SGGS)$_2$. In some embodiments, the linker comprises the amino acid sequence, wherein n is 0, 1, 2, 3, 4, 5, 6, 7, 8, 9, or 10. In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 686). In some embodiments, the linker is 64 amino acids in length. In some embodiments, the linker comprises the amino acid sequence SGGSSGGSSGSETPGTSESATPESSGGSSGGSSG-GSSGGSSGSETPGTSESATPESSGGS SGGS (SEQ ID NO: 687). In some embodiments, the linker is 92 amino acids in length. In some embodiments, the linker comprises the amino acid sequence PGSPAGSPTSTEEGTSESAT-PESGPGTSTEPSEGSAPGSPAGSPTSTEEGTSTEPS-EGSAP GTSTEPSEGSAPGTSESATPESGPGSEPATS (SEQ ID NO: 688).

Some aspects of the disclosure provide fusion proteins comprising a Cas9 domain and an adenosine deaminase. Exemplary fusion proteins include, without limitation, the following fusion proteins (for the purposes of clarity, the adenosine deaminase domain is shown in Bold; mutations of the ecTadA deaminase domain are shown in Bold underlining; the XTEN linker is shown in italics; the UGI/AAG/EndoV domains are shown in Bold italics; and NLS is shown in underlined italics):

```
ecTadA(wt)-XTEN-nCas9-NLS:
                                   (SEQ ID NO: 11)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTDSGSETPGTSESATPESDKKYSIGLAIGTNSVGW

AVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPI

FGNIVDEVAYHEKYPTIYHLRKKLVDSTDKADLRLIYLALAHMIKFRGHF

LIEGDLNPDNSDVDKLFIQLVQTYNQLFEENPINASGVDAKAILSARLSK
```

-continued

SRRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLS
ASMIKRYDEHHQDLTLLKALVRQQLPEKYKEIFFDQSKNGYAGYIDGGAS
QEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYF
TVYNELTKVKYVTEGMRKPAFLSGEQKKAIVDLLFKTNRKVTVKQLKEDY
FKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQGD
SLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQN
GRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRK
DFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDK
LIARKKDWDPKKYGGFDSPTVAYSVLVVAKVEKGKSKKLKSVKELLGITI
MERSSFEKNPIDFLEAKGYKEVKKDLIIKLPKYSLFELENGRKRMLASAG
ELQKGNELALPSKYVNFLYLASHYEKLKGSPEDNEQKQLFVEQHKHYLDE
IIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD
SGGS*PKKKRKV* ecTadA(D108N)-XTEN-nCas9-NLS: (mammalian construct, active on DNA, A to G editing):

(SEQ ID NO: 12)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARNAKTGAAGSLMDVLHHPGMNHRVEITEGILADECAALLSDFFR
MRRQEIKAQKKAQSSTD*SGSETPGTSESATPES*DKKYSIGLAIGTNSVGW
AVITDEYKVPSKKFKVLGNTDRHSIKKNLIGALLFDSGETAEATRLKRTA
RRRYTRRKNRICYLQEIFSNEMAKVDDSFFHRLEESFLVEEDKKHERHPI
FGNIVDEVAYHEKYPTIYHLRKKLVDSTDKADLRLIYLALAHMIKFRGHF
LIEGDLNPDNSDVDKLFIQLVQTYNQLFEENPINASGVDAKAILSARLSK
SRRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLS
ASMIKRYDEHHQDLTLLKALVRQQLPEKYKEIFFDQSKNGYAGYIDGGAS
QEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYF
TVYNELTKVKYVTEGMRKPAFLSGEQKKAIVDLLFKTNRKVTVKQLKEDY
FKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQGD
SLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQN
GRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRK
DFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDK
LIARKKDWDPKKYGGFDSPTVAYSVLVVAKVEKGKSKKLKSVKELLGITI
MERSSFEKNPIDFLEAKGYKEVKKDLIIKLPKYSLFELENGRKRMLASAG
ELQKGNELALPSKYVNFLYLASHYEKLKGSPEDNEQKQLFVEQHKHYLDE
IIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD
SGGS*PKKKRKV* ecTadA(D108G)-XTEN-nCas9-NLS: (mammalian construct, active on DNA, A to G editing):

(SEQ ID NO: 13)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARGAKTGAAGSLMDVLHHPGMNHRVEITEGILADECAALLSDFFR
MRRQEIKAQKKAQSSTD*SGSETPGTSESATPES*DKKYSIGLAIGTNSVGW
AVITDEYKVPSKKFKVLGNTDRHSIKKNLIGALLFDSGETAEATRLKRTA
RRRYTRRKNRICYLQEIFSNEMAKVDDSFFHRLEESFLVEEDKKHERHPI
FGNIVDEVAYHEKYPTIYHLRKKLVDSTDKADLRLIYLALAHMIKFRGHF
LIEGDLNPDNSDVDKLFIQLVQTYNQLFEENPINASGVDAKAILSARLSK
SRRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLS
ASMIKRYDEHHQDLTLLKALVRQQLPEKYKEIFFDQSKNGYAGYIDGGAS
QEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYF
TVYNELTKVKYVTEGMRKPAFLSGEQKKAIVDLLFKTNRKVTVKQLKEDY
FKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQGD
SLHEHIANLAGSPAIKKGILQTVKVVDELVKVMGRHKPENIVIEMARENQ

```
TTQKGQKNSRERMKRIEEGIKELGSQILKEHPVENTQLQNEKLYLYYLQN
GRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRK
DFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDK
LIARKKDWDPKKYGGFDSPTVAYSVLVVAKVEKGKSKKLKSVKELLGITI
MERSSFEKNPIDFLEAKGYKEVKKDLIIKLPKYSLFELENGRKRMLASAG
ELQKGNELALPSKYVNFLYLASHYEKLKGSPEDNEQKQLFVEQHKHYLDE
IIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD
SGGS PKKKRKV
``` ecTadA(D108V)-XTEN-nCas9-NLS: (mammalian construct, active on DNA, A to G editing):

```
                                            (SEQ ID NO: 14)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARVAKTGAAGSLMDVLHHPGMNHRVEITEGILADECAALLSDFFR
MRRQEIKAQKKAQSSTD SGSETPGTSESATPES DKKYSIGLAIGTNSVGW
AVITDEYKVPSKKFKVLGNTDRHSIKKNLIGALLFDSGETAEATRLKRTA
RRRYTRRKNRICYLQEIFSNEMAKVDDSFFHRLEESFLVEEDKKHERHPI
FGNIVDEVAYHEKYPTIYHLRKKLVDSTDKADLRLIYLALAHMIKFRGHF
LIEGDLNPDNSDVDKLFIQLVQTYNQLFEENPINASGVDAKAILSARLSK
SRRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLS
ASMIKRYDEHHQDLTLLKALVRQQLPEKYKEIFFDQSKNGYAGYIDGGAS
QEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYF
TVYNELTKVKYVTEGMRKPAFLSGEQKKAIVDLLFKTNRKVTVKQLKEDY
FKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQGD
SLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQN
GRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRK
DFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDK
LIARKKDWDPKKYGGFDSPTVAYSVLVVAKVEKGKSKKLKSVKELLGITI
MERSSFEKNPIDFLEAKGYKEVKKDLIIKLPKYSLFELENGRKRMLASAG
ELQKGNELALPSKYVNFLYLASHYEKLKGSPEDNEQKQLFVEQHKHYLDE
IIEQISEFSKRVILADANLDKVLSAYNKHRDKPIREQAENIIHLFTLTNL
GAPAAFKYFDTTIDRKRYTSTKEVLDATLIHQSITGLYETRIDLSQLGGD
SGGS PKKKRKV
```

Variant resulting from first round of evolution (in bacteria) ecTadA(H8Y_D108N_N127S)-XTEN-dCas9:

```
                                            (SEQ ID NO: 27)
MSEVEFSYEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARNAKTGAAGSLMDVLHHPGMSHRVEITEGILADECAALLSDFFR
MRRQEIKAQKKAQSSTD SGSETPGTSESATPES DKKYSIGLAIGTNSVGW
AVITDEYKVPSKKFKVLGNTDRHSIKKNLIGALLFDSGETAEATRLKRTA
RRRYTRRKNRICYLQEIFSNEMAKVDDSFFHRLEESFLVEEDKKHERHPI
FGNIVDEVAYHEKYPTIYHLRKKLVDSTDKADLRLIYLALAHMIKFRGHF
LIEGDLNPDNSDVDKLFIQLVQTYNQLFEENPINASGVDAKAILSARLSK
SRRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPLS
ASMIKRYDEHHQDLTLLKALVRQQLPEKYKEIFFDQSKNGYAGYIDGGAS
QEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRK
SEETITPWNFEEVVDKGASAQSFIERMTNFDKNLPNEKVLPKHSLLYEYF
TVYNELTKVKYVTEGMRKPAFLSGEQKKAIVDLLFKTNRKVTVKQLKEDY
FKKIECFDSVEISGVEDRFNASLGTYHDLLKIIKDKDFLDNEENEDILED
IVLTLTLFEDREMIEERLKTYAHLFDDKVMKQLKRRRYTGWGRLSRKLIN
GIRDKQSGKTILDFLKSDGFANRNFMQLIHDDSLTFKEDIQKAQVSGQGD
SLHEHIANLAGSPAIKKGILQTVKVVDELVKVMGRHKPENIVIEMARENQ
TTQKGQKNSRERMKRIEEGIKELGSQILKEHPVENTQLQNEKLYLYYLQN
GRDMYVDQELDINRLSDYDVDAIVPQSFLKDDSIDNKVLTRSDKNRGKSD
NVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRK
DFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDK
LIARKKDWDPKKYGGFDSPTVAYSVLVVAKVEKGKSKKLKSVKELLGITI
MERSSFEKNPIDFLEAKGYKEVKKDLIIKLPKYSLFELENGRKRMLASAG
ELQKGNELALPSKYVNFLYLASHYEKLKGSPEDNEQKQLFVEQHKHYLDE
```

-continued

IIEQISEFSKRVILADANLDKVLSAYNKHRDKPIREQAENIIHLFTLTNL

GAPAAFKYFDTTIDRKRYTSTKEVLDATLIHQSITGLYETRIDLSQLGGD

Enriched variants from second round of evolution (in bacteria) ecTadA (H8Y_D108N_N127S_E155X)-XTEN-dCas9; X=D, G or V:

(SEQ ID NO: 28)
MSEVEFSYEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARNAKTGAAGSLMDVLHHPGMSHRVEITEGILADECAALLSDFFR

MRRQXIKAQKKAQSSTD*SGSETPGTSESATPES*DKKYSIGLAIGTNSVGW

AVITDEYKVPSKKFKVLGNTDRHSIKKNLIGALLFDSGETAEATRLKRTA

RRRYTRRKNRICYLQEIFSNEMAKVDDSFFHRLEESFLVEEDKKHERHPI

FGNIVDEVAYHEKYPTIYHLRKKLVDSTDKADLRLIYLALAHMIKFRGHF

LIEGDLNPDNSDVDKLFIQLVQTYNQLFEENPINASGVDAKAILSARLSK

SRRLENLIAQLPGEKKNGLFGNLIALSLGLTPNFKSNFDLAEDAKLQLSK

DTYDDDLDNLLAQIGDQYADLFLAAKNLSDAILLSDILRVNTEITKAPLS

ASMIKRYDEHHQDLTLLKALVRQQLPEKYKEIFFDQSKNGYAGYIDGGAS

QEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDY

FKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQGD

SLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQN

GRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRK

DFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDK

LIARKKDWDPKKYGGFDSPTVAYSVLVVAKVEKGKSKKLKSVKELLGITI

MERSSFEKNPIDFLEAKGYKEVKKDLIIKLPKYSLFELENGRKMLASAG

ELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNL

GAPAAFKYFDTTIDRKRYTSTKEVLDATLIHQSITGLYETRIDLSQLGGD

ABE7.7: ecTadA$_{(wild\ type)}$-(SGGS)$_2$-XTEN-(SGGS)$_2$-ecTadA$_{(W23L\_H36L\_P48A\_R51L\_L84F\_A106V\_D108N\_H123Y\_S146C\_D147Y\_R152P\_E155V\_I156F\_K157N)}$-(SGGS)$_2$-XTEN-(SGGS)$_2$_nCa-s9_SGGS_NLS (SEQ ID NO: 691)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD*SGGSSGGSSGSETPGTSESATPESSGGSSGGSS*

EVEFSHEYWMRHALTLAKRALDEREVPVGAVLVLNNRVIGEGWNRAIGLH

DPTAHAEIMALRQGGLVMQNYRLIDATLYVTFEPCVMCAGAMIHSRIGRV

VFGVRNAKTGAAGSLMDVLHYPGMNHRVEITEGILADECAALLCYFFRMP

RQVFNAQKKAQSSTD*SGGSSGGSSGSETPGTSESATPESSGGSSGGS*DKK

YSIGLAIGTNSVGWAVITDEYKVPSKKFKVLGNTDRHSIKKNLIGALLFD

SGETAEATRLKRTARRRYTRRKNRICYLQEIFSNEMAKVDDSFFHRLEES

FLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKS

NFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQ

SKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGP

LARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRH

KPENIVIEMARENQTTQKGQKNSRERMKRIEEGIKELGSQILKEHPVENT

QLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAE

RGGLSELDKAGFIKRQLVETRQITKHVAQILDSRMNTKYDENDKLIREVK

VITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGG

FSKESILPKRNSDKLIARKKDWDPKKYGGFDSPTVAYSVLVVAKVEKGKS

KKLKSVKELLGITIMERSSFEKNPIDFLEAKGYKEVKKDLIIKLPKYSLF

ELENGRKMLASAGELQKGNELALPSKYVNFLYLASHYEKLKGSPEDNEQ

KQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITG

LYETRIDLSQLGGDSGGS*PKKKRKV* pNMG-624 amino acid sequence: ecTadA$_{(wild\ type)}$-32 a.a. linker-ecTadA$_{(w23R\_H36L\_P48A\_R51L\_L84F\_A106V\_D108N\_H123Y\_S146C\_D147Y\_R152P\_E155V\_I156F\_K157N)}$-24 a.a. linker_nCa-s9_ SGGS_NLS (SEQ ID NO: 692)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGSS*
EVEFSHEYWMRHALTLAKRARDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTD*SGGSSGGSSGSETPGTSESATPES*DKKYSIGLAIG
TNSVGWAVITDEYKVPSKKFKVLGNTDRHSIKKNLIGALLFDSGETAEAT
RLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEI
TKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRF
AWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVK
QLKEDYFKKIECFDSVETSGVEDRFNASLGTYHDLLKIIKDKDFLDNEEN
EDILEDIVLTLTLFEDREMIEERLKTYAHLFDDKVMKQLKRRRYTGWGRL
SRKLINGIRDKQSGKTILDFLKSDGFANRNFMQLIFIDDSLTFKEDIQKA
QVSGQGDSLHEHIANLAGSPAIKKGILQTVKVVDELVKVMGRHKPENIVI
EMARENQTTQKGQKNSRERMKRIEEGIKELGSQILKEHPVENTQLQNEKL
YLYYLQNGRDMYVDQELDINRLSDYDVDHIVPQSFLKDDSIDNKVLTRSD
KNRGKSDNVPSEEVVKKMKNYWRQLLNAKLITQRKFDNLTKAERGGLSEL
DKAGFIKRQLVETRQITKHVAQILDSRMNTKYDENDKLIREVKVITLKSK
LVSDFRKDFQFYKVREINNYHHAHDAYLNAVVGTALIKKYPKLESEFVYG
DYKVYDVRKMIAKSEQEIGKATAKYFFYSNIMNFFKTEITLANGEIRKRP
LIETNGETGEIVWDKGRDFATVRKVLSMPQVNIVKKTEVQTGGFSKESIL
PKRNSDKLIARKKDWDPKKYGGFDSPTVAYSVLVVAKVEKGKSKKLKSVK
ELLGITIMERSSFEKNPIDFLEAKGYKEVKKDLIIKLPKYSLFELENGRK
RMLASAGELQKGNELALPSKYVNFLYLASHYEKLKGSPEDNEQKQLFVEQ
HKHYLDEIIEQISEFSKRVILADANLDKVLSAYNKHRDKPIREQAENIIH
LFTLTNLGAPAAFKYFDTTIDRKRYTSTKEVLDATLIHQSITGLYETRID
LSQLGGDSGGS*PKKKRK*V ABE3.2: ecTadA$_{(wild-type)}$-(SGGS)$_2$-XTEN-(SGGS)$_2$-ecTadA$_{(L84F\_A106V\_D108N\_H123Y\_D147Y\_E155V\_I156F)}$-(SGGS)$_2$-XTEN-(SGGS)$_2$_nCas9_SGGS_NLS (SEQ ID NO: 693)
**MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD**SGGSSGGS*SGSETPGTSESATPES*SGGSSGGS**S
EVEFSHEYWMRHALTLAKRAWDEREVPVGAVLVHNNRVIGEGWNRPIGRH
DPTAHAEIMALRQGGLVMQNYRLIDATLYVTFEPCVMCAGAMIHSRIGRV
VFGVRNAKTGAAGSLMDVLHYPGMNHRVEITEGILADECAALLSYFFRMR
RQVFKAQKKAQSSTD**SGGSSGGS*SGSETPGTSESATPES*SGGSSGGS*DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRK*V ABE5.3: ecTadA$_{(wild-type)}$-(SGGS)$_2$-XTEN-(SGGS)$_2$-ecTadA$_{(H36L\_R51L\_L84F\_A106V\_D108N\_H123Y\_S146C\_D147Y\_E155V\_I156F\_K157N)}$-(SGGS)$_2$-XTEN-(SGGS)$_2$\_ nCas9\_ SGGS\_NLS (SEQ ID NO: 694)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGS**SGSETPGTSESATPESSGGSSGGS*S
EVEFSHEYWMRHALTLAKRAWDEREVPVGAVLVLNNRVIGEGWNRPIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMR
RQVFNAQKKAQSSTD*SGGSSGGS**SGSETPGTSESATPESSGGSSGGS*DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-558 amino acid sequence: ecTadA$_{(wild-type)}$-32 a.a. linker-ecTadA$_{(H36L\_R51L\_L84F\_A106V\_D108N\_H123Y\_S146C\_D147Y\_E155V\_I156F\_K157N)}$-24 a.a. linker\_nCas9\_SGGS\_NLS (SEQ ID NO: 695)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGS*S
EVEFSHEYWMRHALTLAKRAWDEREVPVGAVLVLNNRVIGEGWNRPIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMR
RQVFNAQKKAQSSTD*SGGSSGGSSGSETPGTSESATPES*DKKYSIGLAIG
TNSVGWAVITDEYKVPSKKFKVLGNTDRHSIKKNLIGALLFDSGETAEAT
RLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEI
TKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRF
AWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIE
MARENQTTQKGQKNSRERMKRIEEGIKELGSQILKEHPVENTQLQNEKLY
LYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKL
VSDFRKDFQFYKVREINNYHHAHDAYLNAVVGTALIKKYPKLESEFVYGD
YKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILP
KRNSDKLIARKKDWDPKKYGGFDSPTVAYSVLVVAKVEKGKSKKLKSVKE
LLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQH
KHYLDEIIEQISEFSKRVILADANLDKVLSAYNKHRDKPIREQAENIIHL
FTLTNLGAPAAFKYFDTTIDRKRYTSTKEVLDATLIHQSITGLYETRIDL
SQLGGDSGGS*PKKKRKV* pNMG-576 amino acid sequence: ecTadA$_{(wild\text{-}type)}$-(SG-GS)$_2$-XTEN-(SGGS)$_2$-ecTadA$_{(H36L\_P48S\_R51L\_L84F\_A106V\_D108N\_H123Y\_S146C\_D147Y\_E155V\_I156F\_K157N)}$-(SGGS)$_2$-XTEN-(SGGS)$_2$_nCas9_GGS_NLS (SEQ ID NO: 696)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRAWDEREVPVGAVLVLNNRVIGEGWNRSIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMR
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-577 amino acid sequence: ecTadA$_{(wild\text{-}type)}$-(SG-GS)$_2$-XTEN-(SGGS)$_2$-ecTadA$_{(H36L\_P48S\_R51L\_L84F\_A106V\_D108N\_H123Y\_A142N\_S146C\_D147Y\_E155V\_I156F\_K157N)}$-(SGGS)$_2$-XTEN-(SGGS)$_2$_nCas9_GGS_NLS (SEQ ID NO: 697)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRAWDEREVPVGAVLVLNNRVIGEGWNRSIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMR
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-586 amino acid sequence: ecTadA$_{(wild-type)}$-(SGGS)$_2$-XTEN-(SGGS)$_2$-ecTadA$_{(H36L\_P48A\_R51L\_L84F\_A106V\_D108N\_H123Y\_S146C\_D147Y\_E155V\_I156F\_K157N)}$-(SGGS)$_2$-XTEN-(SGGS)$_2$_nCas9_GGS_NLS (SEQ ID NO: 698)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRAWDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMR
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV*

ABE7.2: ecTadA$_{(wild-type)}$-(SGGS)$_2$-XTEN-(SGGS)$_2$-ecTadA$_{(H36L\_P48A\_R51L\_L84F\_A106V\_D108N\_H123Y\_A142N\_S146C\_D147Y\_E155V\_I156F\_K157N)}$-(SGGS)$_2$-XTEN-(SGGS)$_2$_nCas9_GGS_NLS (SEQ ID NO: 699)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRAWDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMR
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-620 amino acid sequence: ecTadA$_{(wild-type)}$-(SG-GS)$_2$-XTEN-(SGGS)$_2$-ecTadA$_{(W23R\_H36L\_P48A\_R51L\_L84F\_A106V\_D108N\_H123Y\_S146C\_D147Y\_R152P\_E155V\_I156F\_K157N)}$-(SGGS)$_2$-XTEN-(SGGS)$_2$_nCas9_GGS_NLS (SEQ ID NO: 700)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGSS*
EVEFSHEYWMRHALTLAKRARDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTD*SGGSSGGSSGSETPGTSESATPESSGGSSGGS*DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-617 amino acid sequence: ecTadA(wild-type)-(SGGS)$_2$-XTEN-(SGGS)$_2$-ecTadA$_{(W23L\_H36L\_P48A\_R51L\_L84F\_A106V\_D108N\_H123Y\_A142A\_S146C\_D147Y\_E155V\_I156F\_K157N)}$-(SGGS)$_2$-XTEN-(SGGS)$_2$_nCas9_GGS_NLS (SEQ ID NO: 701)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGSS*
EVEFSHEYWMRHALTLAKRALDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMR
RQVFNAQKKAQSSTD*SGGSSGGSSGSETPGTSESATPESSGGSSGGS*DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV* pNMG-618 amino acid sequence: ecTadA_(wild-type)-(SGGS)2-XTEN-(SGGS)2-ecTadA_(W23L_H36L_P48A_R51L_L84F_A106V_D108N_H123Y_A142A_S146C_D147Y_R152P_E155V_I156F_K157N)-(SGGS)2-XTEN-(SGGS)2_nCas9_GGS_NLS (SEQ ID NO: 702)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRALDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMP
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGSPKKKRKV pNMG-620 amino acid sequence: ecTadA_(wild-type)-(SGGS)2-XTEN-(SGGS)2-ecTadA_(W23R_H36L_P48A_R51L_L84F_A106V_D108N_H123Y_S146C_D147Y_R152P_E155V_I156F_K157N)-(SGGS)2-XTEN-(SGGS)2_nCas9_GGS_NLS (SEQ ID NO: 703)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRARDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTDSGGSSGGSSGSETPGTSESATPESSGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGSPKKKRKV pNMG-621 amino acid sequence: ecTadA$_{(wild-type)}$-32 a.a. linker-ecTadA$_{(H36L\_P48A\_R51L\_L84F\_A106V\_D108N\_H123Y\_S146C\_D147Y\_R152P\_E155V\_I156F\_K157N)}$-24 a.a. linker_nCas9_GGS_NLS (SEQ ID NO: 704)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGS*S
EVEFSHEYWMRHALTLAKRAWDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTD*SGGSSGGSSGSETPGTSESATPES*DKKYSIGLAIG
TNSVGWAVITDEYKVPSKKFKVLGNTDRHSIKKNLIGALLFDSGETAEAT
RLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEI
TKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRF
AWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVK
QLKEDYFKKIECFDSVETSGVEDRFNASLGTYHDLLKIIKDKDFLDNEEN
EDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIE
MARENQTTQKGQKNSRERMKRIEEGIKELGSQILKEHPVENTQLQNEKLY
LYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKL
VSDFRKDFQFYKVREINNYHHAHDAYLNAVVGTALIKKYPKLESEFVYGD
YKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILP
KRNSDKLIARKKDWDPKKYGGFDSPTVAYSVLVVAKVEKGKSKKLKSVKE
LLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQH
KHYLDEIIEQISEFSKRVILADANLDKVLSAYNKHRDKPIREQAENIIHL
FTLTNLGAPAAFKYFDTTIDRKRYTSTKEVLDATLIHQSITGLYETRIDL
SQLGGDSGGS*PKKKRKV* pNMG-622 amino acid sequence: ecTadA$_{(wild-type)}$-32 a.a. linker-ecTadA$_{(H36L\_P48A\_R51L\_L84F\_A106V\_D108N\_H123Y\_A142N\_S146C\_D147Y\_R152P\_E155V\_I156F\_K157N)}$-24 a. a. linker_nCas9_GGS_NLS (SEQ ID NO: 705)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGS*S
EVEFSHEYWMRHALTLAKRAWDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMP
RQVFNAQKKAQSSTD*SGGSSGGSSGSETPGTSESATPES*DKKYSIGLAIG
TNSVGWAVITDEYKVPSKKFKVLGNTDRHSIKKNLIGALLFDSGETAEAT
RLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEI
TKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRF
AWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVK
QLKEDYFKKIECFDSVETSGVEDRFNASLGTYHDLLKIIKDKDFLDNEEN
EDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIE
MARENQTTQKGQKNSRERMKRIEEGIKELGSQILKEHPVENTQLQNEKLY
LYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKL
VSDFRKDFQFYKVREINNYHHAHDAYLNAVVGTALIKKYPKLESEFVYGD
YKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILP
KRNSDKLIARKKDWDPKKYGGFDSPTVAYSVLVVAKVEKGKSKKLKSVKE
LLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQH
KHYLDEIIEQISKRVILADANLDKVLSAYNKHRDKPIREQAENIIHLFTL
TNLGAPAAFKYFDTTIDRKRYTSTKEVLDATLIHQSITGLYETRIDLSQL
GGDSGGS*PKKKRKV* pNMG-623 amino acid sequence: ecTadA_(wild-type)-32 a.a. linker-ecTadA_(w23L_H36L_P48A_R51L_L84F_A106V_D108N_H123Y_S146C_D147Y_R152P_E155V_I156F_K157N)-24 a. a. linker_nCas9_GGS_NLS ABE6.3: ecTadA_(wild-type)-(SGGS)_2-XTEN-(SGGS)_2-ecTadA_(H36L_P48S_R51L_L84F_A106V_D108N_H123Y_S146C_D147Y_E155V_I156F_K157N)-(SGGS)_2-XTEN-(SGGS)_2_nCas9_SGGS_NLS (SEQ ID NO: 706)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGS*S
EVEFSHEYWMRHALTLAKRALDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTD*SGGSSGGSSGSETPGTSESATPES*DKKYSIGLAIG
TNSVGWAVITDEYKVPSKKFKVLGNTDRHSIKKNLIGALLFDSGETAEAT
RLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEI
TKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPH
QIHLGELHAILRRQEDFYPFLKDNREKIEKILTFRIPYYVGPLARGNSRF
AWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVK
QLKEDYFKKIECFDSVETSGVEDRFNASLGTYHDLLKIIKDKDFLDNEEN
EDILEDIVLTLTLFEDREMIEERLKTYAHLFDDKVMKQLKRRRYTGWGRL
SRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIE
MARENQTTQKGQKNSRERMKRIEEGIKELGSQILKEHPVENTQLQNEKLY
LYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELD
KAGFIKRQLVETRQITKHVAQILDSRMNTKYDENDKLIREVKVITLKSKL
VSDFRKDFQFYKVREINNYHHAHDAYLNAVVGTALIKKYPKLESEFVYGD
YKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILP
KRNSDKLIARKKDWDPKKYGGFDSPTVAYSVLVVAKVEKGKSKKLKSVKE
LLGITIMERSSFEKNPIDFLEAKGYKEVKKDLIIKLPKYSLFELENGRKR
MLASAGELQKGNELALPSKYVNFLYLASHYEKLKGSPEDNEQKQLFVEQH
KHYLDEIIEQISEFSKRVILADANLDKVLSAYNKHRDKPIREQAENIIHL
FTLTNLGAPAAFKYFDTTIDRKRYTSTKEVLDATLIHQSITGLYETRIDL
SQLGGDSGGS*PKKKRKV*

(SEQ ID NO: 707)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGS**SGSETPGTSESATPES*SGGSSGGS*S
EVEFSHEYWMRHALTLAKRAWDEREVPVGAVLVLNNRVIGEGWNRSIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMR
RQVFNAQKKAQSSTD*SGGSSGGS**SGSETPGTSESATPES*SGGSSGGSDKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGDSGGS*PKKKRKV*

ABE6.4: ecTadA(wild-type)-(SGGS)2-XTEN-(SGGS)2-ecTadA(H36L_P48S_R51L_L84F_A106V_D108N_H123Y_A142N_S146C_D147Y_E155V_I156F_m57N)-(SGGS)2-XTEN-(SGGS)2_nCas9_SGGS_NLS (SEQ ID NO: 708)

**MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD**SGGSSGGS*SGSETPGTSESATPESS*GGSSGGSS
**EVEFSHEYWMRHALTLAKRAWDEREVPVGAVLVLNNRVIGEGWNRSIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMR
RQVFNAQKKAQSSTD**SGGSSGGS*SGSETPGTSESATPESS*GGSSGGS<u>DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD</u>SGGS*PKKKRKV*

ABE7.8: ecTadA(wild-type)-(SGGS)2-XTEN-(SGGS)2-ecTadA(w23L_H36L_P48A_R51L_L84F_A106V_D108N_H123Y_A142N_S146C_D147Y_E155V_I156F_K157N)-(SGGS)2-XTEN-(SGGS)2_nCas9_SGGS_NLS (SEQ ID NO: 709)

**MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD**SGGSSGGS*SGSETPGTSESATPESS*GGSSGGSS
**EVEFSHEYWMRHALTLAKRALDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECNALLCYFFRMR
RQVFNAQKKAQSSTD**SGGSSGGS*SGSETPGTSESATPESS*GGSSGGS<u>DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVETSGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD</u>SGGS*PKKKRKV*

ABE7.9: ecTadA*(wild-type)*-(SGGS)₂-XTEN-(SGGS)₂-ecTadA*(w23L_H36L_P48A_R51L_L84F_A106V_D108N_H123Y_A142N_S146C_D147Y_R152P_E155V_I156F_K157N)*-*(SGGS)*₂-XTEN-(SGGS)₂_nCas9_SGGS_NLS (SEQ ID NO: 710)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGSS*
EVEFSHEYWMRHALTLAKRALDEREVPVGAVLVLNNRGEGWNRAIGLHDP
TAHAEIMALRQGGLVMQNYRLIDATLYVTFEPCVMCAGAMIHSRIGRVVF
GVRNAKTGAAGSLMDVLHYPGMNHRVEITEGILADECNALLCYFFRMPRQ
VFNAQKKAQSSTD*SGGSSGGSSGSETPGTSESATPESSGGSSGGS*DKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLIARKKDWDPKKYGGFDSPTVAYSVLVVAKVEKGKSKK
LKSVKELLGITIMERSSFEKNPIDFLEAKGYKEVKKDLIIKLPKYSLFEL
ENGRKRMLASAGELQKGNELALPSKYVNFLYLASHYEKLKGSPEDNEQKQ
LFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLY
ETRIDLSQLGGD*SGGSPKKKRKV*

ABE7.10: ecTadA*(wild-type)*-(SGGS)₂-XTEN-(SGGS)₂-ecTadA*(w23R_H36L_P48A_R51L_L84F_A106V_D108N_H123Y_S146C_D147Y_R152P_E155V_I156F_K157N)*-(SGGS)₂-XTEN-(SGGS)₂_nCas9_SGGS_NLS (SEQ ID NO: 711)

MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTD*SGGSSGGSSGSETPGTSESATPESSGGSSGGSS*
EVEFSHEYWMRHALTLAKRARDEREVPVGAVLVLNNRVIGEGWNRAIGLH
DPTAHAEIMALRQGGLVMQNYRLIDATLYVTFEPCVMCAGAMIHSRIGRV
VFGVRNAKTGAAGSLMDVLHYPGMNHRVEITEGILADECAALLCYFFRMP
RQVFNAQKKAQSSTD*SGGSSGGSSGSETPGTSESATPESSGGSSGGS*DKK
YSIGLAIGTNSVGWAVITDEYKVPSKKFKVLGNTDRHSIKKNLIGALLFD
SGETAEATRLKRTARRRYTRRKNRICYLQEIFSNEMAKVDDSFFHRLEES
FLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKS
NFDLAEDAKLQLSKDTYDDDLDNLLAQIGDQYADLFLAAKNLSDAILLSD
ILRVNTEITKAPLSASMIKRYDEHHQDLTLLKALVRQQLPEKYKEIFFDQ
SKNGYAGYIDGGASQEEFYKFIKPILEKMDGTEELLVKLNREDLLRKQRT
FDNGSIPHQIHLGELHAILRRQEDFYPFLKDNREKIEKILTFRIPYYVGP
LARGNSRFAWMTRKSEETITPWNFEEVVDKGASAQSFIERMTNFDKNLPN
EKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDK
DFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTF
KEDIQKAQVSGQGDSLHEHIANLAGSPAIKKGILQTVKVVDELVKVMGRH
KPENIVIEMARENQTTQKGQKNSRERMKRIEEGIKELGSQILKEHPVENT
QLQNEKLYLYYLQNGRDMYVDQELDINRLSDYDVDHIVPQSFLKDDSIDN
KVLTRSDKNRGKSDNVPSEEVVKKMKNYWRQLLNAKLITQRKFDNLTKAE
RGGLSELDKAGFIKRQLVETRQITKHVAQILDSRMNTKYDENDKLIREVK
VITLKSKLVSDFRKDFQFYKVREINNYHHAHDAYLNAVVGTALIKKYPKL
ESEFVYGDYKVYDVRKMIAKSEQEIGKATAKYFFYSNIMNFFKTEITLAN
GEIRKRPLIETNGETGEIVWDKGRDFATVRKVLSMPQVNIVKKTEVQTGG
FSKESILPKRNSDKLIARKKDWDPKKYGGFDSPTVAYSVLVVAKVEKGKS
KKLKSVKELLGITIMERSSFEKNPIDFLEAKGYKEVKKDLIIKLPKYSLF
ELENGRKRMLASAGELQKGNELALPSKYVNFLYLASHYEKLKGSPEDNEQ
KQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITG
LYETRIDLSQLGGD*SGGSPKKKRKV*

In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 11-28, 387, 388, 440, 691-711, or to any of the fusion proteins provided herein. In some embodiments, the fusion protein comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 11-28, 387, 388, 440, 691-711, or any of the fusion proteins provided herein. In some embodiments, the fusion protein comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, at least 170, at least 200, at least 300, at least 400, at least 500, at least 600, at least 700, at least 800, at least 900, at least 1000, at least 1100, at least 1200, at least 1300, at least 1400, at least 1500, at least 1600, at least 1700, at least 1750, or at least 1800 identical contiguous amino acid residues as compared to any one of the amino acid sequences set forth in SEQ ID NOs: 11-28, 387, 388, 440, 691-711, or any of the fusion proteins provided herein.

Complexes of Nucleic Acid Programmable DNA Binding Proteins (napDNAbp) with Guide Nucleic Acids Some aspects of this disclosure provide complexes comprising any of the fusion proteins provided herein, for example any of the adenosine base editors provided herein, and a guide nucleic acid bound to napDNAbp of the fusion protein. In some embodiments, the disclosure provides any of the fusion proteins (e.g., adenosine base editors) provided herein bound to any of the guide RNAs provided herein. In some embodiments, the napDNAbp of the fusion protein (e.g., adenosine base editor) is a Cas9 domain (e.g., a dCas9, a nuclease active Cas9, or a Cas9 nickase), which is bound to a guide RNA. In some embodiments, the complexes provided herein are configured to generate a mutation in a nucleic acid, for example to correct a point mutation in a gene (e.g., HFE, HBB, or F8), or to mutate a promoter (e.g., an HBG1 or HBG2 promoter) to modulate expression of one or more proteins (e.g., gamma globin protein) that are under control of the promoter.

In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a target sequence, for example a target DNA sequence. In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a DNA sequence in a promoter region of an HBG1 or HBG2 gene, for example a promoter region of a human HBG1 or HBG2 gene. In some embodiments, the human hemoglobin subunit gamma 1 (HBG1) is the HBG1 of Gene ID: 3047. In some embodiments, the human hemoglobin subunit gamma 2 (HBG2) is the HBG2 of Gene ID: 3048. In some embodiments, the HBG1 or HBG2 promoter is a human, chimpanzee, ape, monkey, dog, mouse, or rat promoter. In some embodiments, the HBG1 or HBG2 promoter is a human HBG1 or HBG2 promoter. In some embodiments, the HBG1 or HBG2 promoter is from 100 to 300 nucleotides upstream of an HBG1 or HBG2 gene. In some embodiments, the HBG1 or HBG2 promoter is from 100 to 300, 110 to 290, 120 to 280, 130 to 270, 140 to 260, 150 to 250, 160 to 240, 160 to 230, 170 to 220, 180 to 210 or from 190 to 200 nucleotides upstream of an HBG1 or HBG2 gene. In some embodiments, the promoter that drives HBG1 expression comprises a T that is 198 nucleotides upstream of HBG1 (-198T). In some embodiments, the gRNA complexed with any of the fusion proteins provided herein (e.g. adenosine base editors) is designed to target the T at position -198 relative to the HBG1 or HBG2, leading to the mutation of the T to a C. Exemplary HBG1 and HBG2 promoter sequences are provided as SEQ ID NO: 344 and 345, respectively. It should be appreciated that the exemplary HBG1 and HBG2 promoter regions are exemplary and are not meant to be limiting.

In some embodiments, the HBG1 or HBG2 promoter comprises the nucleic acid sequence of any one of the below sequences, such as SEQ ID NOs 838-846, 297-323 and SEQ ID NOs 838-846 having a CCT at the 5' end of the nucleic acid. In some embodiments, the T that is targeted for mutation to a C is indicated in bold in the below sequences.

```
                                       (SEQ ID NO: 838)
5'-CTTGGGGGCCCCTTCCCCACACTA-3';

(SEQ ID NO: 839)
5'-CTTGGGGGCCCCTTCCCCACACT-3';

(SEQ ID NO: 840)
5'-CTTGGGGGCCCCTTCCCCACAC-3';

(SEQ ID NO: 841)
5'-CTTGGGGGCCCCTTCCCCACA-3';

(SEQ ID NO: 842)
5'-CTTGGGGGCCCCTTCCCCAC-3';

(SEQ ID NO: 843)
5'-CTTGGGGGCCCCTTCCCCA-3';

(SEQ ID NO: 844)
5'-CTTGGGGGCCCCTTCCCC-3';

(SEQ ID NO: 845)
5'-CTTGGGGGCCCCTTCCC-3';

(SEQ ID NO: 6)
5'-CCTCTTGGGGGCCCCTTCCCCACACTA-3';

(SEQ ID NO: 7)
5'-CCTCTTGGGGGCCCCTTCCCCACACT-3';

(SEQ ID NO: 15)
5'-CCTCTTGGGGGCCCCTTCCCCACAC-3';

(SEQ ID NO: 16)
5'-CCTCTTGGGGGCCCCTTCCCCACA-3';

(SEQ ID NO: 17)
5'-CCTCTTGGGGGCCCCTTCCCCAC-3';

(SEQ ID NO: 18)
5'-CCTCTTGGGGGCCCCTTCCCCA-3';

(SEQ ID NO: 19)
5'-CCTCTTGGGGGCCCCTTCCCC-3';
or
                                       (SEQ ID NO: 20)
5'-CCTCTTGGGGGCCCCTTCCC-3'.
```

In some embodiments, any of the complexes provided herein comprise a gRNA having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to any one of the nucleic acid sequences provided above (e.g., SEQ ID NOs 838-845, 297-323 and SEQ ID NOs 838-845 further comprising a CCT at the 5' end). It should be appreciated that the guide sequence of the gRNA may comprise one or more nucleotides that are not complementary to a target sequence. In some embodiments, the guide sequence of the gRNA is at the 5' end of the gRNA. In some embodiments, the guide sequence of the gRNA further comprises a G at the 5' end of the gRNA. In some embodiments, the G at the 5' end of the gRNA is not complementary with the target sequence. In some embodiments, the guide sequence of the gRNA comprises 1, 2, 3, 4, 5, 6, 7, or 8 nucleotides that are not complementary to a target sequence (e.g., any of the target sequences provided herein). It should be appreciated that promoter sequences may vary between the genomes of individuals. Thus, the disclosure provides gRNAs having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a HBG1 or HBG2 promoter target sequence in the genome of a human.

In some embodiments, the gRNA comprises a guide sequence comprising any one of SEQ ID NOs: 846-853 and 254-280, provided below.

(SEQ ID NO: 846)
5'-UCAUGUGGGGAAGGGGCCCCCAAG-3';

(SEQ ID NO: 847)
5'-CAUGUGGGGAAGGGGCCCCCAAG-3';

(SEQ ID NO: 848)
5'-AUGUGGGGAAGGGGCCCCCAAG-3';

(SEQ ID NO: 849)
5'-UGUGGGGAAGGGGCCCCCAAG-3'.

(SEQ ID NO: 850)
5'-GUGGGGAAGGGGCCCCCAAG-3';

(SEQ ID NO: 851)
5'-UGGGGAAGGGGCCCCCAAG-3';

(SEQ ID NO: 852)
5'-GGGGAAGGGGCCCCCAAG-3';

(SEQ ID NO: 853)
5'-GGGAAGGGGCCCCCAAG-3';

(SEQ ID NO: 254)
5'-GACAGAUAUUUGCAUUGAGAUAGUGUGG-3';

(SEQ ID NO: 255)
5'-ACAGAUAUUUGCAUUGAGAUAGUGUGG-3';

(SEQ ID NO: 256)
5'-CAGAUAUUUGCAUUGAGAUAGUGUGG-3';

(SEQ ID NO: 257)
5'-AGAUAUUUGCAUUGAGAUAGUGUGG-3';

(SEQ ID NO: 258)
5'-GAUAUUUGCAUUGAGAUAGUGUGG-3';

(SEQ ID NO: 259)
5'-AUAUUUGCAUUGAGAUAGUGUGG-3';

(SEQ ID NO: 260)
5'-AUGCAAAUAUCUGUCUGAAACGG-3';

(SEQ ID NO: 261)
5'-GCAAAUAUCUGUCUGAAACGGUCCCUGG-3';

(SEQ ID NO: 262)
5'-CAAAUAUCUGUCUGAAACGGUCCCUGG-3';

-continued (SEQ ID NO: 263)
5'-AAAUAUCUGUCUGAAACGGUCCCUGG-3';

(SEQ ID NO: 264)
5'-AAUAUCUGUCUGAAACGGUCCCUGG-3';

(SEQ ID NO: 265)
5'-AUAUCUGUCUGAAACGGUCCCUGG-3';

(SEQ ID NO: 266)
5'-UAUCUGUCUGAAACGGUCCCUGG-3';

(SEQ ID NO: 267)
5'-AGAUAUUUGCAUUGAGAUAGUGU-3';

(SEQ ID NO: 268)
5'-ACAGAUAUUUGCAUUGAGAUAGU-3';

(SEQ ID NO: 269)
5'- GUGGGGAAGGGGCCCCCAAGAGG-3';

(SEQ ID NO: 270)
5'-CUUGACCAAUAGCCUUGACAAGG-3';

(SEQ ID NO: 271)
5'-CUUGUCAAGGCUAUUGGUCAAGGCAAGG-3';

(SEQ ID NO: 272)
5'-UUGUCAAGGCUAUUGGUCAAGGCAAGG-3';

(SEQ ID NO: 273)
5'-UGUCAAGGCUAUUGGUCAAGGCAAGG-3';

(SEQ ID NO: 274)
5'-GUCAAGGCUAUUGGUCAAGGCAAGG-3';

(SEQ ID NO: 275)
5'-UCAAGGCUAUUGGUCAAGGCAAGG-3';

(SEQ ID NO: 276)
5'-CAAGGCUAUUGGUCAAGGCAAGG-3';

(SEQ ID NO: 277)
5'-UUGUCAAGGCUAUUGGUCAAGGC-3';

(SEQ ID NO: 278)
5'-CUUGUCAAGGCUAUUGGUCAAGG-3';

(SEQ ID NO: 279)
5'-UUGACCAAUAGCCUUGACAAGGC-3';
or (SEQ ID NO: 280)
5'-UAGCCUUGACAAGGCAAACUUGA-3';

Given that target sequences in the genomes of individuals may vary, it should be appreciated that the RNA sequences provided in SEQ ID NOs: 846-853, and 254-280 may vary by one or more nucleobases. In some embodiments, the guide sequence of any of the guide RNA sequences provided herein may include 1, 2, 3, 4, 5, 6, 7, 8, 9, or 10 nucleobase changes relative to any on of SEQ ID NOs: 846-853, and 254-280. In some embodiments, the guide sequence of the gRNA further comprises a G at the 5' end of the gRNA. Accordingly, the application provides SEQ ID NOs: 846-853, and 254-280, further comprising a G at their 5' ends.

In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a target sequence, for example a target DNA sequence in a hemochromatosis (HFE) gene. In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a DNA sequence in a human HFE gene. In some embodiments, the HFE gene is a human, chimpanzee, ape, monkey, dog, mouse, or rat HFE gene. In some embodiments, the HFE gene is a human HFE gene. In some embodiments, the HFE gene is the HFE gene of Gene ID: 3077, which has also been referred to as HH, HFE1, HLA-H, MVCD7, and TFQTL2. Without wishing to be bound by any particular theory, the HFE protein encoded by this gene is a membrane protein that is similar to MHC class I-type proteins and associates with beta2-microglobulin (beta2M). It is thought that this protein functions to regulate iron absorption by regulating the interaction of the transferrin receptor with transferrin. The iron storage disorder, hereditary haemochromatosis, is a recessive genetic disorder that results from defects in this gene. At least nine alternatively spliced variants have been described for this gene. Additional variants have also been found.

An exemplary coding sequence of the HFE gene is shown below, where the wild-type G that is mutated to an A, causing the Cys (C) to Tyr (Y) mutation at amino acid residue 282 (C282Y), is shown in bold and underlining. In some embodiments, this mutation causes hemochromatosis (e.g., hereditary hemochromatosis):

```
                                      (SEQ ID NO: 871)
ATGGGCCCGCGAGCCAGGCCGGCGCTTCTCCTCCTGATGCTTTTGCAGAC

CGCGGTCCTGCAGGGGCGCTTGCTGCGTTCACACTCTCTGCACTACCTCT

TCATGGGTGCCTCAGAGCAGGACCTTGGTCTTTCCTTGTTTGAAGCTTTG

GGCTACGTGGATGACCAGCTGTTCGTGTTCTATGATCATGAGAGTCGCCG

TGTGGAGCCCCGAACTCCATGGGTTTCCAGTAGAATTTCAAGCCAGATGT

GGCTGCAGCTGAGTCAGAGTCTGAAAGGGTGGGATCACATGTTCACTGTT

GACTTCTGGACTATTATGGAAAATCACAACCACAGCAAGGAGTCCCACAC

CCTGCAGGTCATCCTGGGCTGTGAAATGCAAGAAGACAACAGTACCGAGG

GCTACTGGAAGTACGGGTATGATGGGCAGGACCACCTTGAATTCTGCCCT

GACACACTGGATTGAGAGCAGCAGAACCCAGGGCCTGGCCCACCAAGCT

GGAGTGGGAAAGGCACAAGATTCGGGCCAGGCAGAACAGGGCCTACCTGG

AGAGGGACTGCCCTGCACAGCTGCAGCAGTTGCTGGAGCTGGGGAGAGGT

GTTTTGGACCAACAAGTGCCTCCTTTGGTGAAGGTGACACATCATGTGAC

CTCTTCAGTGACCACTCTACGGTGTCGGGCCTTGAACTACTACCCCAGA

ACATCACCATGAAGTGGCTGAAGGATAAGCAGCCAATGGATGCCAAGGAG

TTCGAACCTAAAGACGTATTGCCCAATGGGGATGGGACCTACCAGGGCTG

GATAACCTTGGCTGTACCCCCTGGGGAAGAGCAGAGATATACGTGCCAGG

TGGAGCACCCAGGCCTGGATCAGCCCCTCATTGTGATCTGGGAGCCCTCA

CCGTCTGGCACCCTAGTCATTGGAGTCATCAGTGGAATTGCTGTTTTTGT

CGTCATCTTGTTCATTGGAATTTTGTTCATAATATTAAGGAAGAGGCAGG

GTTCAAGAGGAGCCATGGGGCACTACGTCTTAGCTGAACGTGAGTGA
```

An exemplary HFE amino acid sequence, encoded from the above HFE nucleic acid coding sequence, is shown below in (SEQ ID NO: 750), where the C at position 282, which is mutated to a Y in hemochromatosis, is indicated in bold and underlining:

```
                                      (SEQ ID NO: 750)
MGPRARPALLLLMLLQTAVLQGRLLRSHSLHYLFMGASEQDLGLSLFEAL

GYVDDQLFVFYDHESRRVEPRTPWVSSRISSQMWLQLSQSLKGWDHMFTV

DFWTIMENHNHSKESHTLQVILGCEMQEDNSTEGYWKYGYDGQDHLEFCP

DTLDWRAAEPRAWPTKLEWERHKIRARQNRAYLERDCPAQLQQLLELGRG

VLDQQVPPLVKVTHHVTSSVTTLRCRALNYYPQNITMKWLKDKQPMDAKE

FEPKDVLPNGDGTYQGWITLAVPPGEEQRYTCQVEHPGLDQPLIVIWEPS

PSGTLVIGVISGIAVFVVILFIGILFIILRKRQGSRGAMGHYVLAER.
```

In some embodiments, the HFE gene comprises a G to A mutation in the coding sequence of the HFE gene, which causes C to Y mutation in the HFE protein. For example a C282Y mutation in SEQ ID NO: 750. In some embodiments, the HFE gene comprises a G to A mutation in nucleic acid residue 845 of SEQ ID NO: 871, which causes C to Y mutation in the encoded HFE protein. In some embodiments, complexes provided herein are designed to correct the C to Y mutation in HFE (e.g., a C282Y mutation of SEQ ID NO: 750) that causes hemochromatosis. It should be appreciated that the coding sequence of HFE may vary between individuals. Thus, the guide sequence of any of the gRNAs provided herein may be engineered to account for such differences to correct the C to Y mutation in HFE that causes hemochromatosis.

In some embodiments, the HFE gene comprises the nucleic acid sequence of any one of the below sequences, such as SEQ ID NOs 854-861 and SEQ ID NOs 854-861 having a CCT at the 5' end of the nucleic acid. In some embodiments, the T that is targeted for mutation to a C is indicated in bold in the below sequences. The A opposite of the targeted T may be deaminated using any of the complexes provided herein. The sequences provided below are reverse complements of portions of the coding sequence of an HFE gene.

```
                                      (SEQ ID NO: 854)
            5'-GGGTGCTCCACCTGGTACGTATAT-3';

(SEQ ID NO: 855)
            5'-GGGTGCTCCACCTGGTACGTATA-3';

(SEQ ID NO: 856)
            5'-GGGTGCTCCACCTGGTACGTAT-3';

(SEQ ID NO: 857)
            5'-GGGTGCTCCACCTGGTACGTA-3';

(SEQ ID NO: 858)
            5'-GGGTGCTCCACCTGGTACGT-3';

(SEQ ID NO: 859)
            5'-GGGTGCTCCACCTGGTACG-3';

(SEQ ID NO: 860)
            5'-GGGTGCTCCACCTGGTAC-3';

(SEQ ID NO: 861)
            5'-GGGTGCTCCACCTGGTA-3';

(SEQ ID NO: 21)
            5'-CCTGGGTGCTCCACCTGGTACGTATAT-3';

(SEQ ID NO: 22)
            5'-CCTGGGTGCTCCACCTGGTACGTATA-3';

(SEQ ID NO: 23)
            5'-CCTGGGTGCTCCACCTGGTACGTAT-3';
```

-continued

```
                                         (SEQ ID NO: 24)
5'-CCTGGGTGCTCCACCTGGTACGTA-3';

(SEQ ID NO: 25)
5'-CCTGGGTGCTCCACCTGGTACGT-3';

(SEQ ID NO: 26)
5'-CCTGGGTGCTCCACCTGGTACG-3';

(SEQ ID NO: 29)
5'-CCTGGGTGCTCCACCTGGTAC-3';
or (SEQ ID NO: 30)
5'-CCTGGGTGCTCCACCTGGTA-3'.
```

In some embodiments, any of the complexes provided herein comprise a gRNA having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to any one of the nucleic acid sequences provided above (e.g., SEQ ID NOs 854-861 and SEQ ID NOs 854-861 having a CCT at the 5' end). It should be appreciated that the guide sequence of the gRNA may comprise one or more nucleotides that are not complementary to a target sequence. In some embodiments, the guide sequence of the gRNA is at the 5' end of the gRNA. In some embodiments, the guide sequence of the gRNA further comprises a G at the 5' end of the gRNA. In some embodiments, the G at the 5' end of the gRNA is not complementary with the target sequence. In some embodiments, the guide sequence of the gRNA comprises 1, 2, 3, 4, 5, 6, 7, or 8 nucleotides that are not complementary to a target sequence (e.g., any of the target sequences provided herein). It should be appreciated that HFE gene sequences may vary between the genomes of individuals. Thus, the disclosure provides gRNAs having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a HFE gene target sequence in the genome of a human.

In some embodiments, the gRNA comprises a guide sequence comprising any one of SEQ ID NOs: 862-869, provided below.

```
                                         (SEQ ID NO: 862)
5'-AUAUACGUACCAGGUGGAGCACCC-3';

(SEQ ID NO: 863)
5'-UAUACGUACCAGGUGGAGCACCC-3';

(SEQ ID NO: 864)
5'-AUACGUACCAGGUGGAGCACCC-3';

(SEQ ID NO: 865)
5'-UACGUACCAGGUGGAGCACCC-3';

(SEQ ID NO: 866)
5'-ACGUACCAGGUGGAGCACCC-3';

(SEQ ID NO: 867)
5'-CGUACCAGGUGGAGCACCC-3';

(SEQ ID NO: 868)
5'-GUACCAGGUGGAGCACCC-3';
or (SEQ ID NO: 869)
5'-UACCAGGUGGAGCACCC-3'.
```

Given that target sequences in the genomes of individuals may vary, it should be appreciated that the RNA sequences provided in SEQ ID NOs: 862-869 may vary by one or more nucleobases. In some embodiments, the guide sequence of any of the guide RNA sequences provided herein may include 1, 2, 3, 4, 5, 6, 7, 8, 9, or 10 nucleobase changes relative to any of SEQ ID NOs: 862-869. In some embodiments, the guide sequence of the gRNA further comprises a G at the 5' end of the gRNA. Accordingly, the application provides SEQ ID NOs: 862-869 that further comprise a G at their 5' ends.

In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a target sequence, for example a target DNA sequence in a beta globin (HBB) gene. In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a DNA sequence in a human HBB gene. In some embodiments, the HBB gene is a human, chimpanzee, ape, monkey, dog, mouse, or rat HBB gene. In some embodiments, the HBB gene is a human HBB gene. In some embodiments, the HBB gene is the HBB gene of Gene ID: 3043, which has also been referred to as ECYT6, CD113t-C, and beta-globin. Without wishing to be bound by any particular theory, the hemoglobin subunit beta is a globin protein, which along with alpha globin (HBA), makes up the most common form of haemoglobin in adult humans. Mutations in the gene produce several variants of the proteins which are implicated with genetic disorders such as sickle-cell disease and beta thalassemia, including hemoglobin C disease (Hb C) and hemoglobin E disease (Hb E).

An exemplary coding sequence of the HBB gene is shown below. In some embodiments, this sequence is mutated (e.g., A to T mutation) to cause sickle cell disease (E6V mutation in the protein). In some embodiments, this sequence is mutated (e.g., G to A mutation) to cause Hb C (E6K mutation in the protein). In some embodiments, this sequence is mutated (e.g., G to A mutation) to cause HbE (E26K mutation in the protein).

Exemplary HBB Gene:

```
                                         (SEQ ID NO: 346)
ACATTTGCTTCTGACACAACTGTGTTCACTAGCAACCTCAAACAGACACC

ATGGTGCATCTGACTCCTGAGGAGAAGTCTGCCGTTACTGCCCTGTGGGG

CAAGGTGAACGTGGATGAAGTTGGTGGTGAGGCCCTGGGCAGGTTGGTAT

CAAGGTTACAAGACAGGTTTAAGGAGACCAATAGAAACTGGGCATGTGGA

GACAGAGAAGACTCTTGGGTTTCTGATAGGCACTGACTCTCTCTGCCTAT

TGGTCTATTTTCCCACCCTTAGGCTGCTGGTGGTCTACCCTTGGACCCAG

AGGTTCTTTGAGTCCTTTGGGGATCTGTCCACTCCTGATGCTGTTATGGG

CAACCCTAAGGTGAAGGCTCATGGCAAGAAAGTGCTCGGTGCCTTTAGTG

ATGGCCTGGCTCACCTGGACAACCTCAAGGGCACCTTTGCCACACTGAGT

GAGCTGCACTGTGACAAGCTGCACGTGGATCCTGAGAACTTCAGGGTGAG

TCTATGGGACGCTTGATGTTTTCTTTCCCCTTCTTTTCTATGGTTAAGTT

CATGTCATAGGAAGGGGATAAGTAACAGGGTACAGTTTAGAATGGGAAAC

AGACGAATGATTGCATCAGTGTGGAAGTCTCAGGATCGTTTTAGTTTCTT

TTATTTGCTGTTCATAACAATTGTTTTCTTTTGTTTAATTCTTGCTTTCT
```

-continued

```
TTTTTTTTCTTCTCCGCAATTTTTACTATTATACTTAATGCCTTAACATT

GTGTATAACAAAAGGAAATATCTCTGAGATACATTAAGTAACTTAAAAAA

AAACTTTACACAGTCTGCCTAGTACATTACTATTTGGAATATATGTGTGC

TTATTTGCATATTCATAATCTCCCTACTTTATTTTCTTTTATTTTTAATT

GATACATAATCATTATACATATTTATGGGTTAAAGTGTAATGTTTTAATA

TGTGTACACATATTGACCAAATCAGGGTAATTTTGCATTTGTAATTTTAA

AAAATGCTTTCTTCTTTTAATATACTTTTTTGTTTATCTTATTTCTAATA

CTTTCCCTAATCTCTTTCTTTCAGGGCAATAATGATACAATGTATCATGC

CTCTTTGCACCATTCTAAAGAATAACAGTGATAATTTCTGGGTTAAGGCA

ATAGCAATATCTCTGCATATAAATATTTCTGCATATAAATTGTAACTGAT

GTAAGAGGTTTCATATTGCTAATAGCAGCTACAATCCAGCTACCATTCTG

CTTTTATTTTATGGTTGGGATAAGGCTGGATTATTCTGAGTCCAAGCTAG

GCCCTTTTGCTAATCATGTTCATACCTCTTATCTTCCTCCCACAGCTCCT

GGGCAACGTGCTGGTCTGTGTGCTGGCCCATCACTTTGGCAAAGAATTCA

CCCCACCAGTGCAGGCTGCCTATCAGAAAGTGGTGGCTGGTGTGGCTAAT

GCCCTGGCCCACAAGTATCACTAAGCTCGCTTTCTTGCTGTCCAATTTCT

ATTAAAGGTTCCTTTGTTCCCTAAGTCCAACTACTAAACTGGGGGATATT

ATGAAGGGCCTTGAGCATCTGGATTCTGCCTAATAAAAAACATTTATTTT

CATTGC
```

An exemplary HBB amino acid sequence, is shown below in (SEQ ID NO: 340), where the E at position 6, which is mutated to a V in sickle cell disease or to a K in Hb C, is indicated in bold and underlining. The E at position 26, which is mutated to a K in Hb E is also indicated in bold and underlining.

```
                                       (SEQ ID NO: 340)
VHLTPEEKSAVTALWGKVNVDEVGGEALGRLLVVYPWTQRFFESFGDLST

PDAVMGNPKVKAHGKKVLGAFSDGLAHLDNLKGTFATLSELHCDKLHVDP

ENFRLLGNVLVCVLAHHFGKEFTPPVQAAYQKVVAGVANALAHKYH
```

In some embodiments, the HBB gene comprises a G to A or A to T mutation in the coding sequence of the HBB gene, which causes a E6V, a E6K, or a E26K mutation in HBB. For example, a E6V, a E6K, or a E26K mutation in SEQ ID NO: 340. In some embodiments, complexes provided herein are designed to correct the E6V (e.g., changing pathogenic V mutation to non-pathogenic A mutation), a E6K, or a E26K mutation in HBB, that causes sickle cell disease, Hb C, and Hb E, respectively. It should be appreciated that the coding sequence of HBB may vary between individuals. Thus, the guide sequence of any of the gRNAs provided herein may be engineered to account for such differences to correct the mutations provided herein.

In some embodiments, the HBB gene comprises the nucleic acid sequence, or a reverse complement thereof, of any one of the below sequences, such as SEQ ID NOs 324-337. In some embodiments, the T that is targeted for mutation to a C is indicated in bold in the below sequences. The A opposite of the targeted T may be deaminated using any of the complexes provided herein.

```
                                       (SEQ ID NO: 324)
5'-GTGCATCTGACTCCTGTGGAGAA-3';

(SEQ ID NO: 325)
5'-GGTGCATCTGACTCCTGTGGAGA-3';

(SEQ ID NO: 326)
5'-CCATGGTGCATCTGACTCCTGTGGAGAA-3';

(SEQ ID NO: 327)
5'-CCATGGTGCATCTGACTCCTGTGGAGA-3';

(SEQ ID NO: 328)
5'-CCATGGTGCATCTGACTCCTGTGGAG-3';

(SEQ ID NO: 329)
5'-CCATGGTGCATCTGACTCCTGTGGA-3';

(SEQ ID NO: 330)
5'-CCATGGTGCATCTGACTCCTGTGG-3';

(SEQ ID NO: 331)
5'-CCATGGTGCATCTGACTCCTGTG-3';

(SEQ ID NO: 332)
5'-GCATCTGACTCCTGTGGAGAAGT-3';

(SEQ ID NO: 333)
5'-ACCATGGTGCATCTGACTCCTGTGGAGA-3';

(SEQ ID NO: 334)
5'-ACGGCAGACTTCTCCTTAGGAGT-3';

(SEQ ID NO: 335)
5'-CCTGCCCAGGGCCTTACCACCAA-3';

(SEQ ID NO: 336)
5'-ACCTGCCCAGGGCCTTACCACCA-3';
or
                                       (SEQ ID NO: 337)
5'-CCAACCTGCCCAGGGCCTTACCA-3'
```

In some embodiments, any of the complexes provided herein comprise a gRNA having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to any one of the nucleic acid sequences provided above (e.g., SEQ ID NOs 324-337). It should be appreciated that the guide sequence of the gRNA may comprise one or more nucleotides that are not complementary to a target sequence. In some embodiments, the guide sequence of the gRNA is at the 5' end of the gRNA. In some embodiments, the guide sequence of the gRNA further comprises a G at the 5' end of the gRNA. In some embodiments, the G at the 5' end of the gRNA is not complementary with the target sequence. In some embodiments, the guide sequence of the gRNA comprises 1, 2, 3, 4, 5, 6, 7, or 8 nucleotides that are not complementary to a target sequence (e.g., any of the target sequences provided herein). It should be appreciated that BB gene sequences may vary between the genomes of individuals. Thus, the disclosure provides gRNAs having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a HBB gene target sequence in the genome of a human.

In some embodiments, the gRNA comprises a guide sequence comprising any one of SEQ ID NOs: 281-294, provided below. SEQ ID NOs: 281-290 are designed to treat sickle cell disease (e.g., changing E6V mutation to have an A at position 6, which is non-pathogenic). SEQ ID NO: 291 is designed to treat Hb C (e.g., E6K mutation). SEQ ID NOs: 292-294 are designed to Hb E (e.g., E26K mutation).

```
5'-UUCUCCACAGGAGUCAGAUGCAC-3';          (SEQ ID NO: 281)

5'-UCUCCACAGGAGUCAGAUGCACC-3';          (SEQ ID NO: 282)

5'-UUCUCCACAGGAGUCAGAUGCACCAUGG-3';     (SEQ ID NO: 283)

5'-UCUCCACAGGAGUCAGAUGCACCAUGG-3';      (SEQ ID NO: 284)

5'-CUCCACAGGAGUCAGAUGCACCAUGG-3';       (SEQ ID NO: 285)

5'-UCCACAGGAGUCAGAUGCACCAUGG-3';        (SEQ ID NO: 286)

5'-CCACAGGAGUCAGAUGCACCAUGG-3';         (SEQ ID NO: 287)

5'-CACAGGAGUCAGAUGCACCAUGG-3';          (SEQ ID NO: 288)

5'-ACUUCUCCACAGGAGUCAGAUGC-3';          (SEQ ID NO: 289)

5'-UCUCCACAGGAGUCAGAUGCACCAUGGU-3';     (SEQ ID NO: 290)

5'-ACUCCUAAGGAGAAGUCUGCCGU-3';          (SEQ ID NO: 291)

5'-UUGGUGGUAAGGCCCUGGGCAGG-3';          (SEQ ID NO: 292)

5'-UGGUGGUAAGGCCCUGGGCAGGU-3';          (SEQ ID NO: 293)
or

5'-UGGUAAGGCCCUGGGCAGGUUGG-3'.          (SEQ ID NO: 294)
```

Given that target sequences in the genomes of individuals may vary, it should be appreciated that the RNA sequences provided in SEQ ID NOs: 281-294 may vary by one or more nucleobases. In some embodiments, the guide sequence of any of the guide RNA sequences provided herein may include 1, 2, 3, 4, 5, 6, 7, 8, 9, or 10 nucleobase changes relative to any of SEQ ID NOs: 281-294. In some embodiments, the guide sequence of the gRNA further comprises a G at the 5' end of the gRNA. Accordingly, the application provides SEQ ID NOs: 281-294 that further comprise a G at their 5' ends.

In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a target sequence, for example a target DNA sequence in a coagulation factor VIII (F8) gene. In some embodiments, the guide RNA comprises a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a DNA sequence in a human F8 gene. In some embodiments, the F8 gene is a human, chimpanzee, ape, monkey, dog, mouse, or rat F8 gene. In some embodiments, the F8 gene is a human F8 gene. In some embodiments, the F8 gene is the F8 gene of Gene ID: 2157, which has also been referred to as AHF, F8B, F8C, HEMA, FVIII, and DXS1253E. Without wishing to be bound by any particular theory, F8 encodes coagulation factor VIII, which participates in the intrinsic pathway of blood coagulation; factor VIII is a cofactor for factor IXa which, in the presence of $Ca^{+2}$ and phospholipids, converts factor X to the activated form Xa. Defects in this gene results in hemophilia A, a common recessive X-linked coagulation disorder.

An exemplary coding sequence of the F8 gene is provided as SEQ ID NO: 347. In some embodiments, this sequence is mutated (e.g., C to T mutation) to cause hemophilia A (R612C mutation in the protein).

An exemplary coagulation factor VIII amino acid sequence, is shown below in (SEQ ID NO: 341), where the R at position 612, which is mutated to a C in hemophilia A is indicated in bold and underlining.

```
                                        (SEQ ID NO: 341)
MQIELSTCFFLCLLRFCFSATRRYYLGAVELSWDYMQSDLGELPVDARFP

PRVPKSFPFNTSVVYKKTLFVEFTDHLFNIAKPRPPWMGLLGPTIQAEVY

DTVVITLKNMASHPVSLHAVGVSYWKASEGAEYDDQTSQREKEDDKVFPG

GSHTYVWQVLKENGPMASDPLCLTYSYLSHVDLVKDLNSGLIGALLVCRE

GSLAKEKTQTLHKFILLFAVFDEGKSWHSETKNSLMQDRDAASARAWPKM

HTVNGYVNRSLPGLIGCHRKSVYWHVIGMGTTPEVHSIFLEGHTFLVRNH

RQASLEISPITFLTAQTLLMDLGQFLLFCHISSHQHDGMEAYVKVDSCPE

EPQLRMKNNEEAEDYDDDLTDSEMDVVRFDDDNSPSFIQIRSVAKKHPKT

WVHYIAAEEEDWDYAPLVLAPDDRSYKSQYLNNGPQRIGRKYKKVRFMAY

TDETFKTREAIQHESGILGPLLYGEVGDTLLIIFKNQASRPYNIYPHGIT

DVRPLYSRRLPKGVKHLKDFPILPGEIFKYKWTVTVEDGPTKSDPRCLTR

YYSSFVNMERDLASGLIGPLLICYKESVDQRGNQIMSDKRNVILFSVFDE

NRSWYLTENIQRFLPNPAGVQLEDPEFQASNIMHSINGYVFDSLQLSVCL

HEVAYWYILSIGAQTDFLSVFFSGYTFKHKMVYEDTLTLFPFSGETVFMS

MENPGLWILGCHNSDFRNRGMTALLKVSSCDKNTGDYYEDSYEDISAYLL

SKNNAIEPRSFSQNSRHPSTRQKQFNATTIPENDIEKTDPWFAHRTPMPK

IQNVSSSDLLMLLRQSPTPHGLSLSDLQEAKYETFSDDPSPGAIDSNNSL

SEMTHFRPQLHHSGDMVFTPESGLQLRLNEKLGTTAATELKKLDFKVSST

SNNLISTIPSDNLAAGTDNTSSLGPPSMPVHYDSQLDTTLFGKKSSPLTE

SGGPLSLSEENNDSKLLESGLMNSQESSWGKNVSSTESGRLFKGKRAHGP

ALLTKDNALFKVSISLLKTNKTSNNSATNRKTHIDGPSLLIENSPSVWQN

ILESDTEFKKVTPLIHDRMLMDKNATALRLNHMSNKTTSSKNMEMVQQKK

EGPIPPDAQNPDMSFFKMLFLPESARWIQRTHGKNSLNSGQGPSPKQLVS

LGPEKSVEGQNFLSEKNKVVVGKGEFTKDVGLKEMVFPSSRNLFLTNLDN

LHENNTHNQEKKIQEEIEKKETLIQENVVLPQIHTVTGTKNFMKNLFLLS

TRQNVEGSYDGAYAPVLQDFRSLNDSTNRTKKHTAHFSKKGEEENLEGLG

NQTKQIVEKYACTTRISPNTSQQNFVTQRSKRALKQFRLPLEETELEKRI

IVDDTSTQWSKNMKHLTPSTLTQIDYNEKEKGAITQSPLSDCLTRSHSIP

QANRSPLPIAKVSSFPSIRPIYLTRVLFQDNSSHLPAASYRKKDSGVQES

SHFLQGAKKNNLSLAILTLEMTGDQREVGSLGTSATNSVTYKKVENTVLP

KPDLPKTSGKVELLPKVHIYQKDLFPTETSNGSPGHLDLVEGSLLQGTEG

AIKWNEANRPGKVPFLRVATESSAKTPSKLLDPLAWDNHYGTQIPKEEWK

SQEKSPEKTAFKKKDTILSLNACESNHAIAAINEGQNKPEIEVTWAKQGR
```

-continued

TERLCSQNPPVLKRHQREITRTTLQSDQEEIDYDDTISVEMKKEDFDIYD

EDENQSPRSFQKKTRHYFIAAVERLWDYGMSSSPHVLRNRAQSGSVPQFK

KVVFQEFTDGSFTQPLYRGELNEHLGLLGPYIRAEVEDNIMVTFRNQASR

PYSFYSSLISYEEDQRQGAEPRKNFVKPNETKTYFWKVQHHMAPTKDEFD

CKAWAYFSDVDLEKDVHSGLIGPLLVCHTNTLNPAHGRQVTVQEFALFFT

IFDETKSWYFTENMERNCRAPCNIQMEDPTFKENYRFHAINGYIMDTLPG

LVMAQDQRIRWYLLSMGSNENIHSIHFSGHVFTVRKKEEYKMALYNLYPG

VFETVEMLPSKAGIWRVECLIGEHLHAGMSTLFLVYSNKCQTPLGMASGH

IRDFQITASGQYGQWAPKLARLHYSGSINAWSTKEPFSWIKVDLLAPMII

HGIKTQGARQKFSSLYISQFIIMYSLDGKKWQTYRGNSTGTLMVFFGNVD

SSGIKHNIFNPPIIARYIRLHPTHYSIRSTLRMELMGCDLNSCSMPLGME

SKAISDAQITASSYFTNMFATWSPSKARLHLQGRSNAWRPQVNNPKEWLQ

VDFQKTMKVTGVTTQGVKSLLTSMYVKEFLISSSQDGHQWTLFFQNGKVK

VFQGNQDSFTPVVNSLDPPLLTRYLRIHPQSWVHQIALRMEVLGCEAQDL

Y

In some embodiments, the F8 gene comprises a C to T mutation in the coding sequence of the F8 gene, which causes an R to C mutation in coagulation factor VIII. For example, an R612C mutation in SEQ ID NO: 341. In some embodiments, complexes provided herein are designed to correct the R to C (e.g., R612C) mutation in F8, which causes hemophilia A. It should be appreciated that the coding sequence of F8 may vary between individuals. Thus, the guide sequence of any of the gRNAs provided herein may be engineered to account for such differences to correct the mutations provided herein.

In some embodiments, the F8 gene comprises the nucleic acid sequence, or a reverse complement thereof, of any one of the below sequences, such as SEQ ID NOs 338-339. In some embodiments, the T that is targeted for mutation to a C is indicated in bold in the below sequences. The A opposite of the targeted T may be deaminated using any of the complexes provided herein.

(SEQ ID NO: 338)
5'-CCTCACAGAGAATATACAATGCT-3';
or (SEQ ID NO: 339)
5'-TCACAGAGAATATACAATGCTTT-3'.

In some embodiments, any of the complexes provided herein comprise a gRNA having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to any one of the nucleic acid sequences provided above (e.g., SEQ ID NOs 338-339). It should be appreciated that the guide sequence of the gRNA may comprise one or more nucleotides that are not complementary to a target sequence. In some embodiments, the guide sequence of the gRNA is at the 5' end of the gRNA. In some embodiments, the guide sequence of the gRNA further comprises a G at the 5' end of the gRNA. In some embodiments, the G at the 5' end of the gRNA is not complementary with the target sequence. In some embodiments, the guide sequence of the gRNA comprises 1, 2, 3, 4, 5, 6, 7, or 8 nucleotides that are not complementary to a target sequence (e.g., any of the target sequences provided herein). It should be appreciated that F8 gene sequences may vary between the genomes of individuals. Thus, the disclosure provides gRNAs having a guide sequence that comprises at least 8, 9, 10, 11, 12, 13, 14, 15, 16, 17, 18, 19, 20, 21, 22, 23, 24, 25, 26, 27, 28, 29, or 30 contiguous nucleic acids that are 100% complementary to a F8 gene target sequence in the genome of a human.

In some embodiments, the gRNA comprises a guide sequence comprising any one of SEQ ID NOs: 295-296, provided below, which are designed treat hemophilia A (e.g., R612C mutation, e.g., of SEQ ID NO: 341).

(SEQ ID NO: 295)
5'-AGCAUUGUAUAUUCUCUGUGAGG-3';
or (SEQ ID NO: 296)
5'-AAAGCAUUGUAUAUUCUCUGUGA-3'

Given that target sequences in the genomes of individuals may vary, it should be appreciated that the RNA sequences provided in SEQ ID NOs: 295-296 may vary by one or more nucleobases. In some embodiments, the guide sequence of any of the guide RNA sequences provided herein may include 1, 2, 3, 4, 5, 6, 7, 8, 9, or 10 nucleobase changes relative to any of SEQ ID NOs: 295-295. In some embodiments, the guide sequence of the gRNA further comprises a G at the 5' end of the gRNA. Accordingly, the application provides SEQ ID NOs: 295-296 that further comprise a G at their 5' ends.

In some embodiments, the guide nucleic acid (e.g., guide RNA) is from 15-150 nucleotides long and comprises a guide sequence of at least 10 contiguous nucleotides that is complementary to a target sequence. In some embodiments, the guide RNA is at least 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90, 100, 110, 120, 130, 140, or 150 nucleotides long. In some embodiments, the guide RNA comprises a guide sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence, for example any of the HBG1 or HBG2 promoter sequences provided herein or any of the HFE, HBB, or F8 target sequences provided herein. In some embodiments, the target sequence is a DNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder, e.g., hereditary persistence of fetal hemoglobin (HPFH), beta-thalassemia, hereditary hemochromatosis (HHC), sickle cell disease, Hb C, Hb E, or hemophilia (e.g., hemophilia A).

Methods of Using Fusion Proteins Comprising an Adenosine Deaminase and a Nucleic Acid Programmable DNA Binding Protein (napDNAbp) Domain Some aspects of this disclosure provide methods of using the fusion proteins, or complexes comprising a guide nucleic acid (e.g., gRNA) and a nucleobase editor provided herein. For example, some aspects of this disclosure provide methods comprising contacting a DNA, or RNA molecule with any of the fusion proteins provided herein, and with at least one guide nucleic acid (e.g., guide RNA), wherein the guide nucleic acid, (e.g., guide RNA) is comprises a sequence (e.g., a guide sequence that binds to a DNA target sequence) of at least 10 (e.g., at least 10, 15, 20, 25, or 30) contiguous nucleotides that is 100% complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

Expressing Hemoglobin

Some aspects of the disclosure provide methods of introducing disease-suppressing mutations in cells (e.g., mammalian cells). In some embodiments, the disclosure provides methods of using base editors (e.g., any of the fusion proteins provided herein) and gRNAs to modulate expression of a hemoglobin gene (e.g., HBG1 and/or HBG2). In some embodiments, the disclosure provides methods of using base editors (e.g., any of the fusion proteins provided herein) and gRNAs to generate an A to T and/or T to C mutation in a promoter region of HBG1 and/or HBG2.

Humans with the rare benign condition hereditary persistence of fetal hemoglobin (HPFH) are resistant to some β-globin diseases including sickle-cell anemia. In certain patients, this phenotype is mediated by mutations in the promoters of the γ-globin genes HBG1 and HBG2 that enable sustained expression of fetal hemoglobin, which is normally silenced in humans around birth. Without wishing to be bound by any particular theory, generating one or more mutations in a promoter region of HBG1 or HBG2 can increase expression of HBG1 and/or HBG2 in order to treat β-globin diseases.

In some embodiments, the methods include deaminating an adenosine nucleobase (A) in a promoter of an HBG1 or HBG2 gene by contacting the promoter with a base editor and a guide RNA bound to the base editor, where the guide RNA (gRNA) comprises a guide sequence that is complementary to a target nucleic acid sequence in the promoter of the HBG1 and/or HBG2 gene. It should be appreciated that the prompter of the HBG1 and HBG2 genes can include any of the sequences of the HBG1 and HBG2 promoters described herein. In some embodiments, the guide sequence of the gRNA comprises at least 5, 6, 7, 8, 9, 10, 11, 12, 13, 14, 15, 16, 17, 18, 19, 20, 21, 22, 23, 24, 26, 27, 28, 29, 30, 31, 32, 33, 34, 35, 36, 37, 38, 39, 40, or more contiguous nucleic acids that are 100% complementary to a target nucleic acid sequence in a promoter sequence of HBG1 or HBG2.

In some embodiments, the methods further comprising nicking the target sequence, which may be achieved by using a nucleic acid programmable binding protein (napDNAbp), such as a Cas9 nickase (nCas9) that nicks the target sequence that is complementary to the guide sequence of the gRNA. In some embodiments, the target nucleic acid sequence in the promotor comprises the nucleic acid sequence

```
                                        (SEQ ID NO: 838)
5'-CTTGGGGGCCCCTTCCCCACACTA-3';

(SEQ ID NO: 839)
5'-CTTGGGGGCCCCTTCCCCACACT-3';
```

```
                                        (SEQ ID NO: 840)
5'-CTTGGGGGCCCCTTCCCCACAC-3';

(SEQ ID NO: 841)
5'-CTTGGGGGCCCCTTCCCCACA-3';

(SEQ ID NO: 842)
5'-CTTGGGGGCCCCTTCCCCAC-3';

(SEQ ID NO: 843)
5'-CTTGGGGGCCCCTTCCCCA-3';

(SEQ ID NO: 844)
5'-CTTGGGGGCCCCTTCCCC-3';

(SEQ ID NO: 845)
5'-CTTGGGGGCCCCTTCCC-3';
``` or any one of SEQ ID NOs: 297-323.

It should be appreciated that any of the the nucleic acids of SEQ ID NOs: 838-845 may further comprise 5'-CCT-3' at their 5' end.

In some embodiments, the guide sequence of the gRNA comprises the nucleic acid sequence

```
                                        (SEQ ID NO: 846)
5'-UCAUGUGGGGAAGGGGCCCCCAAG-3';

(SEQ ID NO: 847)
5'-CAUGUGGGGAAGGGGCCCCCAAG-3';

(SEQ ID NO: 848)
5'-AUGUGGGGAAGGGGCCCCCAAG-3';

(SEQ ID NO: 849)
5'-UGUGGGGAAGGGGCCCCCAAG-3'.

(SEQ ID NO: 850)
5'-GUGGGGAAGGGGCCCCCAAG-3';

(SEQ ID NO: 851)
5'-UGGGGAAGGGGCCCCCAAG-3';

(SEQ ID NO: 852)
5'-GGGGAAGGGGCCCCCAAG-3';

(SEQ ID NO: 853)
5'-GGGAAGGGGCCCCCAAG-3'
``` or any one of SEQ ID NOs: 254-280.

It should be appreciated that any of the the nucleic acids of SEQ ID NOs: 846-853, or 254-280 may further comprise a G at their 5' end.

In some embodiments, deaminating the adenosine nucleobase in the promoter of HBG1 or HBG2 results in a T-A base pair in the promoter being mutated to a C-G base pair in the promoter. In some embodiments, deaminating the adenosine nucleobase in the promoter results in a sequence associated with hereditary persistence of fetal hemoglobin (HPFH). Hereditary persistence of fetal hemoglobin, in some embodiments, is characterized as a benign condition in which fetal hemoglobin (e.g., hemoglobin F) is expressed in adulthood. In some embodiments, HPFH is characterized by expression of fetal hemoglobin in a subject of 2 years or older, 5 years or older, 10 years or older, 15 years or older 20 years or older, 25 years or older, or 30 years or older. In some embodiments, HPFH is considered to be expressed in an adult if it is expressed at a level that is at least 5%, 10%, 15%, 20%, 25%, 30%, 40%, 50%, 60%, 70%, 80% or more greater than in a normal subject of 2 years or older, 5 years or older, 10 years or older, 15 years or older 20 years or older, 25 years or older, or 30 years or older.

In some embodiments, deaminating the adenosine nucleobase in the promoter of the HBG1 gene leads to an increase in transcription of the HBG1 gene by at least 5%, 10%, 15%, 20%, 25%, 30%, 40%, 50%, 60%, 70%, 80%, 90%, 100%, 200%, 500%, 1000% or more relative to a healthy adult or a fetus that expresses HBG1. In some embodiments, deaminating the adenosine nucleobase in the promoter of the HBG2 gene leads to an increase in transcription of the HBG2 gene by at least 5%, 10%, 15%, 20%, 25%, 30%, 40%, 50%, 60%, 70%, 80%, 90%, 100%, 200%, 500%, 1000% or more relative to a healthy adult or a fetus that expresses HBG1. In some embodiments, deaminating the adenosine nucleobase in the promoter of the HBG1 gene leads to an increase HBG1 protein levels by at least 5%, 10%, 15%, 20%, 25%, 30%, 40%, 50%, 60%, 70%, 80%, 90%, 100%, 200%, 500%, 1000% or more relative to a healthy adult or a fetus that expresses HBG1. In some embodiments, deaminating the adenosine nucleobase in the promoter of the HBG2 gene leads to an increase in HBG2 protein levels by at least 5%, 10%, 15%, 20%, 25%, 30%, 40%, 50%, 60%, 70%, 80%, 90%, 100%, 200%, 500%, 1000% or more relative to a healthy adult or a fetus that expresses HBG2.

In some embodiments, the method is performed in vitro, for example in cultured cells. In some embodiments, the method is performed in vivo. In some embodiments, the method is performed ex vivo. In some embodiments, the method is performed in the cell of a subject. In some embodiments, the subject has or is suspected of having a disease or disorder of the blood. In some embodiments, the disease or disorder is an anemia. In some embodiments, the anemia is iron deficiency anemia, aplastic anemia, haemolytic anemia, thalassaemia, sickle cell anemia, pernicious anemia, or fanconi anemia. In some embodiments, the disease or disorder is caused by a mutation in a gene or a promoter of a gene encoding a globin protein, for example CYGB, HBA1, HBA2, HBB, HBD, HBE1, HBG1, HBG2, HBM, HBQ1, HBZ, or MB.

Correcting Mutations in an HFE Gene

Some aspects of the disclosure provide methods of using base editors (e.g., any of the fusion proteins provided herein) and gRNAs to correct a point mutation in an HFE gene. In some embodiments, the disclosure provides methods of using base editors (e.g., any of the fusion proteins provided herein) and gRNAs to generate an A to G and/or T to C mutation in an HFE gene. In some embodiments, the disclosure provides method for deaminating an adenosine nucleobase (A) in an HFE gene, the method comprising contacting the HFE gene with a base editor and a guide RNA bound to the base editor, where the guide RNA comprises a guide sequence that is complementary to a target nucleic acid sequence in the HFE gene. In some embodiments, the HFE gene comprises a C to T or G to A mutation. In some embodiments, the C to T or G to A mutation in the HFE gene impairs function of the HFE protein encoded by the HFE gene. In some embodiments, the C to T or G to A mutation in the HFE gene impairs function of the HFE protein encoded by the HFE gene by at least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99%. In some embodiments, the function of the HFE protein is iron absorption.

In some embodiments, deaminating an adenosine (A) nucleobase complementary to the T corrects the C to T or G to A mutation in the HFE gene. In some embodiments, the C to T or G to A mutation in the HFE gene leads to a Cys (C) to Tyr (Y) mutation in the HFE protein encoded by the HFE gene. In some embodiments, deaminating the adenosine nucleobase complementary to the T corrects the Cys to Tyr mutation in the HFE protein.

In some embodiments, the guide sequence of the gRNA comprises at least 8, 9, 10, 11, 12, 13, 14, 15, 16, 17, 18, 19, 20, 21, 22, 23, 24, 25, 26, 27, 28, 29, 30, 31, 32, 33, 34, or 35 contiguous nucleic acids that are 100% complementary to a target nucleic acid sequence of the HFE gene. In some embodiments, the base editor nicks the target sequence that is complementary to the guide sequence. In some embodiments, the target nucleic acid sequence in the HFE gene comprises the nucleic acid sequence:

```
                                        (SEQ ID NO: 854)
    5'-GGGTGCTCCACCTGGTACGTATAT-3';

(SEQ ID NO: 855)
    5'-GGGTGCTCCACCTGGTACGTATA-3';

(SEQ ID NO: 856)
    5'-GGGTGCTCCACCTGGTACGTAT-3';

(SEQ ID NO: 857)
    5'-GGGTGCTCCACCTGGTACGTA-3';

(SEQ ID NO: 858)
    5'-GGGTGCTCCACCTGGTACGT-3';

(SEQ ID NO: 859)
    5'-GGGTGCTCCACCTGGTACG-3';

(SEQ ID NO: 860)
    5'-GGGTGCTCCACCTGGTAC-3';
    or (SEQ ID NO: 861)
    5'-GGGTGCTCCACCTGGTA-3'.
```

It should be appreciated that any of the the nucleic acids of SEQ ID NOs: 854-861 may further comprise 5'-CCT-3' at their 5' end.

In some embodiments, the guide sequence of the gRNA comprises the nucleic acid sequence:

```
                                        (SEQ ID NO: 862)
    5'-AUAUACGUACCAGGUGGAGCACCC-3';

(SEQ ID NO: 863)
    5'-UAUACGUACCAGGUGGAGCACCC-3';

(SEQ ID NO: 864)
    5'-AUACGUACCAGGUGGAGCACCC-3';

(SEQ ID NO: 865)
    5'-UACGUACCAGGUGGAGCACCC-3';

(SEQ ID NO: 866)
    5'-ACGUACCAGGUGGAGCACCC-3';

(SEQ ID NO: 867)
    5'-CGUACCAGGUGGAGCACCC-3';

(SEQ ID NO: 868)
    5'-GUACCAGGUGGAGCACCC-3';
    or (SEQ ID NO: 869)
    5'-UACCAGGUGGAGCACCC-3'.
```

It should be appreciated that any of the the nucleic acids of SEQ ID NOs: 862-869 may further comprise a G at their 5' end.

In some embodiments, deaminating the adenosine nucleobase in the HFE gene results in a T-A base pair in the HFE gene being mutated to a C-G base pair in the HFE gene. In some embodiments, deaminating the adenosine nucleobase in the HFE gene results in correcting a sequence associated with hereditary hemochromatosis (HHC). In some embodiments, deaminating the adenosine nucleobase in the HFE gene results in an increase in HFE protein function. In some embodiments, deaminating the adenosine nucleobase in the HFE gene results in increase in HFE protein function to at least 20%, 25%, 30%, 35%, 40%, 45%, 50%, 55%, 60%, 65%, 70%, 75%, 80%, 85%, 90%, 95%, 98%, 99%, or at least 100% as compared to wild-type HFE protein function. In some embodiments, deaminating the adenosine nucleobase in the HFE gene results in a decrease in one or more symptoms of hemochromatosis. In some embodiments, deaminating the adenosine nucleobase in the HFE gene results in an increase in iron absorption function. In some embodiments, deaminating the adenosine nucleobase in the HFE gene results in an increase in iron absorption function to least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99% of a normal level of iron absorption, for example a level of iron absorption in a subject that does not have hemochromatosis. In some embodiments, deaminating the adenosine nucleobase in the HFE gene leads to an increase in function of HFE protein transcribed from the HFE gene. In some embodiments, deaminating the adenosine nucleobase in the HFE gene leads to an increase in HFE stability or half life, for example by at least 5%, 10%, 15%, 20%, 25%, 30%, 35%, 40%, 45%, 50%, 55%, 60%, 65%, 70%, 75%, 80%, 85%, 90%, 95%, 98%, or at least 99%.

In some embodiments, the HFE gene is in a cell, such as a cell in culture (e.g., an immortalized lymphoblastoid cell (LCL)) or a cell in a subject. In some embodiments, the HFE gene encodes an HFE protein comprising a Cys to Tyr mutation. In some embodiments, the HFE protein comprises a Cys to Tyr mutation (C282Y) at residue 282 of the amino acid sequence SEQ ID NO: 750, where the Cys at position 282 is shown in bold:

```
                                        (SEQ ID NO: 750)
MGPRARPALLLLMLLQTAVLQGRLLRSHSLHYLFMGASEQDLGLSLFEAL

GYVDDQLFVFYDHESRRVEPRTPWVSSRISSQMWLQLSQSLKGWDHMFTV

DFWTIMENHNHSKESHTLQVILGCEMQEDNSTEGYWKYGYDGQDHLEFCP

DTLDWRAAEPRAWPTKLEWERHKIRARQNRAYLERDCPAQLQQLLELGRG

VLDQQVPPLVKVTHHVTSSVTTLRCRALNYYPQNITMKWLKDKQPMDAKE

FEPKDVLPNGDGTYQGWITLAVPPGEEQRYTCQVEHPGLDQPLIVIWEPS

PSGTLVIGVISGIAVFVVILFIGILFIILRKRQGSRGAMGHYVLAER.
```

In some embodiments, the method is performed in vivo. In some embodiments, the method is performed in vivo. In some embodiments, the method is performed ex vivo. In some embodiments, the method is performed in a cell of a subject. In some embodiments, the subject has or is suspected of having an iron storage disorder. In some embodiments, the subject has or is suspected of having hemochromatosis. In some embodiments, the subject has or is suspected of having hereditary hemochromatosis (HHC). In some embodiments, the subject has a mutation in an HFE gene, where a wild-type G that is mutated to an A (e.g., a G845A mutation in SEQ ID NO: 871), causes a Cys (C) to Tyr (Y) mutation, for example at amino acid residue 282 (C282Y) of SEQ ID NO: 750. In some embodiments, this mutation causes hemochromatosis (e.g., hereditary hemochromatosis). In some embodiments, deaminating the adenosine nucleobase in the HFE gene ameliorates one or more symptoms of the iron storage disorder in the subject.

Correcting/Generating Mutations in an HBB Gene

Some aspects of the disclosure provide methods of using base editors (e.g., any of the fusion proteins provided herein) and gRNAs to correct a point mutation in an HBB gene, or generate a point mutation that is non-pathogenic. In some embodiments, the disclosure provides methods of using base editors (e.g., any of the fusion proteins provided herein) and gRNAs to generate an A to G and/or T to C mutation in an HBB gene. In some embodiments, the disclosure provides method for deaminating an adenosine nucleobase (A) in an HBB gene, the method comprising contacting the HBB gene with a base editor and a guide RNA bound to the base editor, where the guide RNA comprises a guide sequence that is complementary to a target nucleic acid sequence in the HBB gene. In some embodiments, the HBB gene comprises a A to T or G to A mutation. In some embodiments, the A to T or G to A mutation in the HBB gene impairs function of the beta globin protein encoded by the HBB gene. In some embodiments, the A to T or G to A mutation in the HBB gene impairs function of the HBB protein encoded by the HBB gene by at least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99%. In some embodiments, the function of the HBB protein is oxygen carrying capacity. In some embodiments, the A to T mutation causes sickle cell disease and changing the T:A base pair to a C:G base pair yields a non-pathogenic point mutation that decreases the ability of the hemoglobin to polymerize, e.g., by at least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99%.

In some embodiments, deaminating an adenosine (A) nucleobase complementary to the T corrects the C to T or G to A mutation in the HBB gene or generates a non-pathogenic mutation. In some embodiments, the A to T or G to A mutation in the HBB gene leads to an E to V mutation or an E to K mutation in the HBB protein encoded by the HBB gene. In some embodiments, deaminating the adenosine nucleobase complementary to the T corrects the E to K mutation in the HBB protein. For example deaminating the adenosine nucleobase complementary to the T corrects an E6K (Hb C) or an E26K (Hb E) mutation in HBB, for example as compared to SEQ ID NO: 340. In some embodiments, deaminating the adenosine nucleobase complementary to the T changes a pathogenic mutation to a non-pathogenic mutation. For example an E6V mutation in HBB (e.g., as compared to SEQ ID NO: 340) can be mutated to generate an A at position 6 (e.g., V6A mutation) to yield a non-pathogenic mutation.

In some embodiments, the guide sequence of the gRNA comprises at least 8, 9, 10, 11, 12, 13, 14, 15, 16, 17, 18, 19, 20, 21, 22, 23, 24, 25, 26, 27, 28, 29, 30, 31, 32, 33, 34, or 35 contiguous nucleic acids that are 100% complementary to a target nucleic acid sequence of the HBB gene. In some embodiments, the base editor nicks the target sequence that is complementary to the guide sequence. In some embodiments, the target nucleic acid sequence in the HBB gene comprises the nucleic acid sequence:

5'-GTGCATCTGACTCCTGTGGAGAA-3'; (SEQ ID NO: 324)

5'-GGTGCATCTGACTCCTGTGGAGA-3'; (SEQ ID NO: 325)

5'-CCATGGTGCATCTGACTCCTGTGGAGAA-3'; (SEQ ID NO: 326)

5'-CCATGGTGCATCTGACTCCTGTGGAGA-3'; (SEQ ID NO: 327)

5'-CCATGGTGCATCTGACTCCTGTGGAG-3'; (SEQ ID NO: 328)

5'-CCATGGTGCATCTGACTCCTGTGGA-3'; (SEQ ID NO: 329)

5'-CCATGGTGCATCTGACTCCTGTGG-3'; (SEQ ID NO: 330)

5'-CCATGGTGCATCTGACTCCTGTG-3'; (SEQ ID NO: 331)

5'-GCATCTGACTCCTGTGGAGAAGT-3'; (SEQ ID NO: 332)

5'-ACCATGGTGCATCTGACTCCTGTGGAGA-3'; (SEQ ID NO: 333)

5'-ACGGCAGACTTCTCCTTAGGAGT-3'; (SEQ ID NO: 334)

5'-CCTGCCCAGGGCCTTACCACCAA-3'; (SEQ ID NO: 335)

5'-ACCTGCCCAGGGCCTTACCACCA-3'; (SEQ ID NO: 336)
or

5'-CCAACCTGCCCAGGGCCTTACCA-3'. (SEQ ID NO: 337)

In some embodiments, the guide sequence of the gRNA comprises the nucleic acid sequence:

5'-UUCUCCACAGGAGUCAGAUGCAC-3'; (SEQ ID NO: 281)

5'-UCUCCACAGGAGUCAGAUGCACC-3'; (SEQ ID NO: 282)

5'-UUCUCCACAGGAGUCAGAUGCACCAUGG-3'; (SEQ ID NO: 283)

5'-UCUCCACAGGAGUCAGAUGCACCAUGG-3'; (SEQ ID NO: 284)

5'-CUCCACAGGAGUCAGAUGCACCAUGG-3'; (SEQ ID NO: 285)

5'-UCCACAGGAGUCAGAUGCACCAUGG-3'; (SEQ ID NO: 286)

5'-CCACAGGAGUCAGAUGCACCAUGG-3'; (SEQ ID NO: 287)

5'-CACAGGAGUCAGAUGCACCAUGG-3'; (SEQ ID NO: 288)

5'-ACUUCUCCACAGGAGUCAGAUGC-3'; (SEQ ID NO: 289)

5'-UCUCCACAGGAGUCAGAUGCACCAUGGU-3'; (SEQ ID NO: 290)

5'-ACUCCUAAGGAGAAGUCUGCCGU-3'; (SEQ ID NO: 291)

5'-UUGGUGGUAAGGCCCUGGGCAGG-3'; (SEQ ID NO: 292)

5'-UGGUGGUAAGGCCCUGGGCAGGU-3'; (SEQ ID NO: 293)
or

5'-UGGUAAGGCCCUGGGCAGGUUGG-3'. (SEQ ID NO: 294)

It should be appreciated that any of the the nucleic acids of SEQ ID NOs: 281-294 may further comprise a G at their 5' end.

In some embodiments, deaminating the adenosine nucleobase in the HBB gene results in a T-A base pair in the HBB gene being mutated to a C-G base pair in the HBB gene. In some embodiments, deaminating the adenosine nucleobase in the HBB gene results in correcting a sequence associated with Hb C or Hb E; or results in generating a non-pathogenic mutation. In some embodiments, deaminating the adenosine nucleobase in the HBB gene results in an increase in HBB protein function. In some embodiments, deaminating the adenosine nucleobase in the HBB gene results in increase in HBB protein function to at least 20%, 25%, 30%, 35%, 40%, 45%, 50%, 55%, 60%, 65%, 70%, 75%, 80%, 85%, 90%, 95%, 98%, 99%, or at least 100% as compared to wild-type HBB protein function. In some embodiments, deaminating the adenosine nucleobase in the HBB gene results in a decrease in one or more symptoms of sickle cell disease, Hb C, or Hb E. In some embodiments, deaminating the adenosine nucleobase in the HBB gene results in an increase in oxygen carrying function, or in a decrease in polymerization of beta globin, or a decrease in cell sickling. In some embodiments, deaminating the adenosine nucleobase in the HBB gene results in an increase in oxygen carrying function to least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99% of a normal level of oxygen carrying function, for example a level of oxygen carrying function (e.g., oxygen saturation) in a subject that does not have sickle cell, Hb C, and/or Hb E. In some embodiments, deaminating the adenosine nucleobase in the HBB gene leads to an increase in function of HBB protein transcribed from the HBB gene. In some embodiments, deaminating the adenosine nucleobase in the HBB gene leads to an increase in HBB stability or half life, for example by at least 5%, 10%, 15%, 20%, 25%, 30%, 35%, 40%, 45%, 50%, 55%, 60%, 65%, 70%, 75%, 80%, 85%, 90%, 95%, 98%, or at least 99%.

In some embodiments, the HBB gene is in a cell, such as a cell in culture or a cell in a subject. In some embodiments, the HBB gene encodes an HBB protein comprising an E to V or E to K mutation. In some embodiments, the HBB protein comprises a E to V mutation (E6V) at residue 6 of the amino acid sequence SEQ ID NO: 340 (sickle cell disease), where the E at position 6 is shown in bold. In some embodiments, the HBB protein comprises an E to K mutation (E6K) at residue 6 of the amino acid sequence SEQ ID NO: 340 (Hb C), where the E at position 6 is shown in bold. In some embodiments, the HBB protein comprises a E to K mutation (E26K) at residue 6 of the amino acid sequence SEQ ID NO: 340 (Hb E), where the E at position 26 is shown in bold and underlined:

```
                                                      (SEQ ID NO: 340)
VHLTPEEKSAVTALWGKVNVDEVGGEALGRLLVVYPWTQRFFESFGDL

STPDAVMGNPKVKAHGKKVLGAFSDGLAHLDNLKGTFATLSELHCDKL

HVDPENFRLLGNVLVCVLAHHFGKEFTPPVQAAYQKVVAGVANALAHK

YH.
```

In some embodiments, the method is performed in vivo. In some embodiments, the method is performed in vivo. In some embodiments, the method is performed ex vivo. In some embodiments, the method is performed in a cell of a subject. In some embodiments, the subject has or is suspected of having an iron storage disorder. In some embodiments, the subject has or is suspected of having sickle cell disease, or beta-thalassemia. In some embodiments, the subject has or is suspected of having Hb C or Hb E. In some embodiments, the subject has a mutation in an HBB gene, where a wild-type A is mutated to a T, or a wild-type G is mutated to an A. In some embodiments, deaminating the adenosine nucleobase in the HBB gene ameliorates one or more symptoms of sickle cell disease, Hb C, or Hb E in the subject.

Correcting Mutations in an F8 Gene

Some aspects of the disclosure provide methods of using base editors (e.g., any of the fusion proteins provided herein) and gRNAs to correct a point mutation in an F8 gene. In some embodiments, the disclosure provides methods of using base editors (e.g., any of the fusion proteins provided herein) and gRNAs to generate an A to G and/or T to C mutation in an F gene. In some embodiments, the disclosure provides method for deaminating an adenosine nucleobase (A) in an F8 gene, the method comprising contacting the F8 gene with a base editor and a guide RNA bound to the base editor, where the guide RNA comprises a guide sequence that is complementary to a target nucleic acid sequence in the F8 gene. In some embodiments, the F8 gene comprises a C to T or G to A mutation. In some embodiments, the C to T or G to A mutation in the F8 gene impairs function of the coagulation factor VIII protein encoded by the F8 gene. In some embodiments, the C to T or G to A mutation in the F8 gene impairs function of the coagulation factor VIII protein encoded by the F8 gene by at least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99%. In some embodiments, the function of the coagulation factor VIII protein is blood clotting.

In some embodiments, deaminating an adenosine (A) nucleobase complementary to the T corrects the C to T or G to A mutation in the F8 gene. In some embodiments, the C to T or G to A mutation in the F8 gene leads to an R to C mutation in the factor VIII protein encoded by the F8 gene. In some embodiments, deaminating the adenosine nucleobase complementary to the T corrects the R to C mutation in the factor VIII protein.

In some embodiments, the guide sequence of the gRNA comprises at least 8, 9, 10, 11, 12, 13, 14, 15, 16, 17, 18, 19, 20, 21, 22, 23, 24, 25, 26, 27, 28, 29, 30, 31, 32, 33, 34, or 35 contiguous nucleic acids that are 100% complementary to a target nucleic acid sequence of the F8 gene. In some embodiments, the base editor nicks the target sequence that is complementary to the guide sequence. In some embodiments, the target nucleic acid sequence in the F8 gene comprises the nucleic acid sequence:

```
                                                      (SEQ ID NO: 338)
        5'-CCTCACAGAGAATATACAATGCT-3';
        or
                                                      (SEQ ID NO: 339)
        5'-TCACAGAGAATATACAATGCTTT-3'.
```

In some embodiments, the guide sequence of the gRNA comprises the nucleic acid sequence:

```
                                                      (SEQ ID NO: 295)
        5'-AGCAUUGUAUAUUCUCUGUGAGG-3';
        or
                                                      (SEQ ID NO: 296)
        5'-AAAGCAUUGUAUAUUCUCUGUGA-3'.
```

It should be appreciated that any of the the nucleic acids of SEQ ID NOs: 295-296 may further comprise a G at their 5' end.

In some embodiments, deaminating the adenosine nucleobase in the F8 gene results in a T-A base pair in the F8 gene being mutated to a C-G base pair in the F8 gene. In some embodiments, deaminating the adenosine nucleobase in the F8 gene results in correcting a sequence associated with hemophilia (e.g., hemophilia A). In some embodiments, deaminating the adenosine nucleobase in the F8 gene results in an increase in factor VIII protein function. In some embodiments, deaminating the adenosine nucleobase in the F8 gene results in increase in factor VIII protein function to at least 20%, 25%, 30%, 35%, 40%, 45%, 50%, 55%, 60%, 65%, 70%, 75%, 80%, 85%, 90%, 95%, 98%, 99%, or at least 100% as compared to wild-type factor VIII protein function. In some embodiments, deaminating the adenosine nucleobase in the F8 gene results in a decrease in one or more symptoms of hemophilia. In some embodiments, deaminating the adenosine nucleobase in the F8 gene results in an increase in blood clotting function. In some embodiments, deaminating the adenosine nucleobase in the F8 gene results in an increase in blood clotting function to least 1%, 2%, 5%, 10%, 15%, 20%, 25%, 30%, 35%, 40%, 45%, 50%, 55%, 60%, 65%, 70%, 75%, 80%, 85%, 90%, 95%, 98%, or at least 99% of a normal level of blood clotting function, for example a level of blood clotting function in a subject that does not have hemophelia. In some embodiments, deaminating the adenosine nucleobase in the F8 gene leads to an increase in function of factor VIII protein transcribed from the F8 gene. In some embodiments, deaminating the adenosine nucleobase in the F8 gene leads to an increase in factor VIII stability or half life, for example by at least 5%, 10%, 15%, 20%, 25%, 30%, 35%, 40%, 45%, 50%, 55%, 60%, 65%, 70%, 75%, 80%, 85%, 90%, 95%, 98%, or at least 99%.

In some embodiments, the F8 gene is in a cell, such as a cell in culture or a cell in a subject. In some embodiments, the F8 gene encodes a factor VIII protein comprising a R to C mutation. In some embodiments, the factor VIII protein comprises a R to C mutation (R612C) at residue 612 of the amino acid sequence SEQ ID NO: 341, where the R at position 612 is shown in bold:

```
                                                      (SEQ ID NO: 341)
MQIELSTCFFLCLLRFCFSATRRYYLGAVELSWDYMQSDLGELPVDARF

PPRVPKSFPFNTSVVYKKTLFVEFTDHLFNIAKPRPPWMGLLGPTIQAE

VYDTVVITLKNMASHPVSLHAVGVSYWKASEGAEYDDQTSQREKEDDKV
```

-continued

FPGGSHTYVWQVLKENGPMASDPLCLTYSYLSHVDLVKDLNSGLIGALL

VCREGSLAKEKTQTLHKFILLFAVFDEGKSWHSETKNSLMQDRDAASAR

AWPKMHTVNGYVNRSLPGLIGCHRKSVYWHVIGMGTTPEVHSIFLEGHT

FLVRNHRQASLEISPITFLTAQTLLMDLGQFLLFCHISSHQHDGMEAYV

KVDSCPEEPQLRMKNNEEAEDYDDDLTDSEMDVVRFDDDNSPSFIQIRS

VAKKHPKTWVHYIAAEEEDWDYAPLVLAPDDRSYKSQYLNNGPQRIGRK

YKKVRFMAYTDETFKTREAIQHESGILGPLLYGEVGDTLLIIFKNQASR

PYNIYPHGITDVRPLYSRRLPKGVKHLKDFPILPGEIFKYKWTVTVEDG

PTKSDPRCLTRYYSSFVNMERDLASGLIGPLLICYKESVDQRGNQIMSD

KRNVILFSVFDENRSWYLTENIQRFLPNPAGVQLEDPEFQASNIMHSIN

GYVFDSLQLSVCLHEVAYWYILSIGAQTDFLSVFFSGYTFKHKMVYEDT

LTLFPFSGETVFMSMENPGLWILGCHNSDFRNRGMTALLKVSSCDKNTG

DYYEDSYEDISAYLLSKNNAIEPRSFSQNSRHPSTRQKQFNATTIPEND

IEKTDPWFAHRTPMPKIQNVSSSDLLMLLRQSPTPHGLSLSDLQEAKYE

TFSDDPSPGAIDSNNSLSEMTHFRPQLHHSGDMVFTPESGLQLRLNEKL

GTTAATELKKLDFKVSSTSNNLISTIPSDNLAAGTDNTSSLGPPSMPVH

YDSQLDTTLFGKKSSPLTESGGPLSLSEENNDSKLLESGLMNSQESSWG

KNVSSTESGRLFKGKRAHGPALLTKDNALFKVSISLLKTNKTSNNSATN

RKTHIDGPSLLIENSPSVWQNILESDTEFKKVTPLIHDRMLMDKNATAL

RLNHMSNKTTSSKNMEMVQQKKEGPIPPDAQNPDMSFFKMLFLPESARW

IQRTHGKNSLNSGQGPSPKQLVSLGPEKSVEGQNFLSEKNKVVVGKGEF

TKDVGLKEMVFPSSRNLFLTNLDNLHENNTHNQEKKIQEEIEKKETLIQ

ENVVLPQIHTVTGTKNFMKNLFLLSTRQNVEGSYDGAYAPVLQDFRSLN

DSTNRTKKHTAHFSKKGEEENLEGLGNQTKQIVEKYACTTRISPNTSQQ

NFVTQRSKRALKQFRLPLEETELEKRIIVDDTSTQWSKNMKHLTPSTLT

QIDYNEKEKGAITQSPLSDCLTRSHSIPQANRSPLPIAKVSSFPSIRPI

YLTRVLFQDNSSHLPAASYRKKDSGVQESSHFLQGAKKNNLSLAILTLE

MTGDQREVGSLGTSATNSVTYKKVENTVLPKPDLPKTSGKVELLPKVHI

YQKDLFPTETSNGSPGHLDLVEGSLLQGTEGAIKWNEANRPGKVPFLRV

ATESSAKTPSKLLDPLAWDNHYGTQIPKEEWKSQEKSPEKTAFKKKDTI

LSLNACESNHAIAAINEGQNKPEIEVTWAKQGRTERLCSQNPPVLKRHQ

REITRTTLQSDQEEIDYDDTISVEMKKEDFDIYDEDENQSPRSFQKKTR

HYFIAAVERLWDYGMSSSPHVLRNRAQSGSVPQFKKVVFQEFTDGSFTQ

PLYRGELNEHLGLLGPYIRAEVEDNIMVTFRNQASRPYSFYSSLISYEE

DQRQGAEPRKNFVKPNETKTYFWKVQHHMAPTKDEFDCKAWAYFSDVDL

EKDVHSGLIGPLLVCHTNTLNPAHGRQVTVQEFALFFTIFDETKSWYFT

ENMERNCRAPCNIQMEDPTFKENYRFHAINGYIMDTLPGLVMAQDQRIR

WYLLSMGSNENIHSIHFSGHVFTVRKKEEYKMALYNLYPGVFETVEMLP

SKAGIWRVECLIGEHLHAGMSTLFLVYSNKCQTPLGMASGHIRDFQITA

SGQYGQWAPKLARLHYSGSINAWSTKEPFSWIKVDLLAPMIIHGIKTQG

-continued

ARQKFSSLYISQFIIMYSLDGKKWQTYRGNSTGTLMVFFGNVDSSGIKH

NIFNPPIIARYIRLHPTHYSIRSTLRMELMGCDLNSCSMPLGMESKAIS

DAQITASSYFTNMFATWSPSKARLHLQGRSNAWRPQVNNPKEWLQVDFQ

KTMKVTGVTTQGVKSLLTSMYVKEFLISSSQDGHQWTLFFQNGKVKVFQ

GNQDSFTPVVNSLDPPLLTRYLRIHPQSWVHQIALRMEVLGCEAQDLY

In some embodiments, the method is performed in vivo. In some embodiments, the method is performed in vivo. In some embodiments, the method is performed ex vivo. In some embodiments, the method is performed in a cell of a subject. In some embodiments, the subject has or is suspected of having hemophilia. In some embodiments, the subject has or is suspected of having hemophilia A. In some embodiments, the subject has a mutation in an F8 gene, where a wild-type G that is mutated to an A, which causes a R to C mutation, for example at amino acid residue 612 (R612C) of SEQ ID NO: 341. In some embodiments, this mutation causes hemophilia (e.g., hemophilia A). In some embodiments, deaminating the adenosine nucleobase in the F8 gene ameliorates one or more symptoms of the hemophilia in the subject.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G→A or C→T point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder.

Some embodiments provide methods for using the DNA editing fusion proteins provided herein. In some embodiments, the fusion protein is used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., hereditary hemochromatosis. In some embodiments, the methods provided herein are used to introduce a point mutation into a promoter of a gene (e.g., a HBG1 or HBG2) that modulates (e.g. increases or decreases) expression of the gene. For example, in some embodiments, methods are provided herein that employ a DNA editing fusion protein to introduce a point mutation into a promoter region of HBG1 or HBG2 to increase expression of HBG1 or HBG2. Such point mutations may, in some embodiments, increase expression of HBG1 or HBG2 in a subject, which may be useful for treating β-globin diseases including sickle-cell anemia.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain can be used to correct any single point G to A or C to T mutation. In the first case, deamination of the mutant A to I corrects the mutation, and in the latter case, deamination of the A that is base-paired with the mutant T, followed by a round of replication or followed by base editing repair activity, corrects the mutation.

The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., anemia, or hemochromatosis, an effective amount of an adenosine deaminase fusion protein that corrects a point mutation in a gene (e.g., HFE) or introduces a mutation into a promoter region of a gene (e.g., a promoter region of HBG1 or HBG2). In some embodiments, the disease is a genetic disease. In some embodiments, the disease is a disease associated with anemia. In some embodiments, the disease is an iron storage disease (e.g., hereditary hemochromatosis). In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

In some embodiments, a fusion protein recognizes canonical PAMs and therefore can correct the pathogenic G to A or C to T mutations with canonical PAMs, e.g., NGG, respectively, in the flanking sequences. For example, Cas9 proteins that recognize canonical PAMs comprise an amino acid sequence that is at least 80%, 85%, 90%, 95%, 97%, 98%, or 99% identical to the amino acid sequence of *Streptococcus pyogenes* Cas9 as provided by SEQ ID NO: 52, or to a fragment thereof comprising the RuvC and HNH domains of SEQ ID NO: 52.

Figure 17:
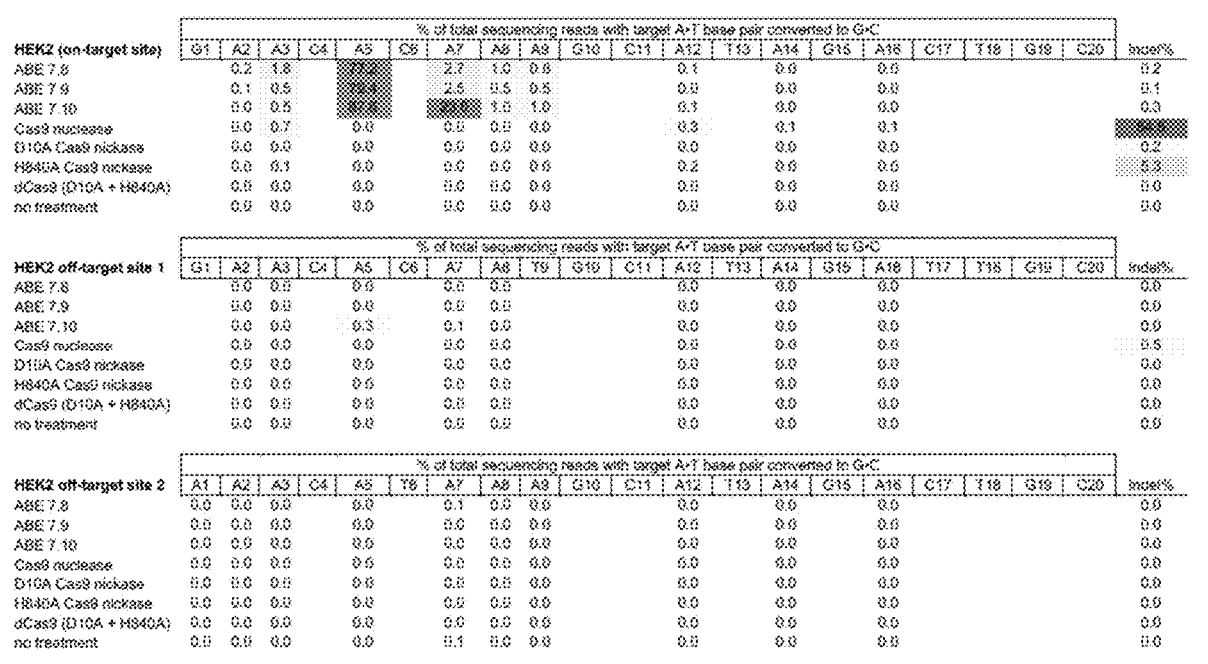
Figure 18:
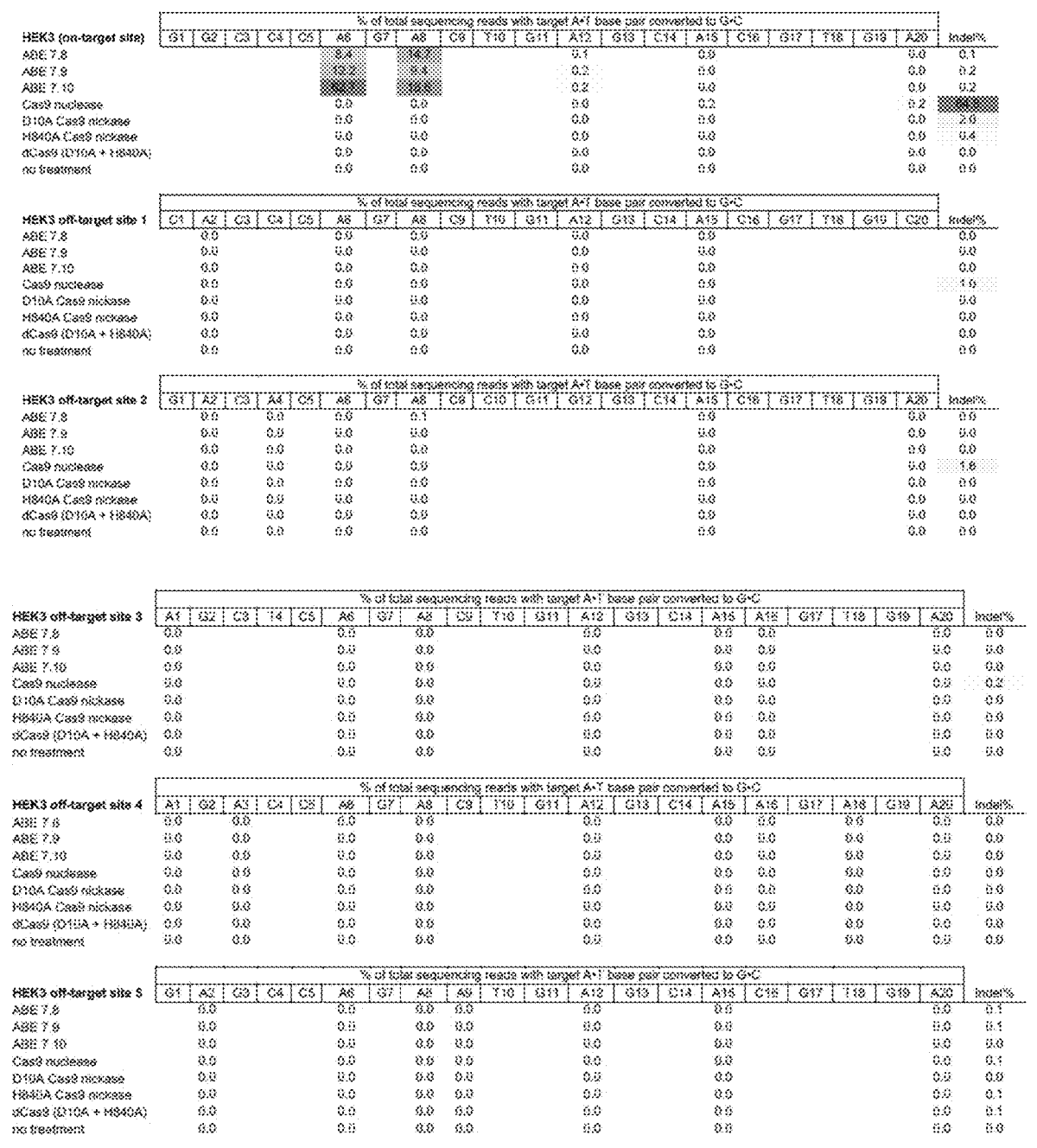

It will be apparent to those of skill in the art that in order to target any of the fusion proteins comprising a Cas9 domain and an adenosine deaminase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcuagaaauagcaaguuaaaauaaaggcuaguccguuaucaacuugaaaaaguggcaccgagucggugcuu uuu-3' (SEQ ID NO: 389), wherein the guide sequence comprises a sequence that is complementary to the target sequence. In some embodiments, the guide sequence comprises any of the nucleotide sequences provided in FIG. 17. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are shown in FIG. 18, including their locus.

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. in some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the first nucleobase is an adenine. In some embodiments, the second nucleobase is a deaminated adenine, or inosine. In some embodiments, the third nucleobase is a thymine. In some embodiments, the fourth nucleobase is a cytosine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., A:T to G:C). In some embodiments, the fifth nucleobase is a guanine. In some embodiments, at least 5% of the intended base pairs are edited. In some embodiments, at least 10%, 15%, 20%, 25%, 30%, 35%, 40%, 45%, or 50% of the intended base paires are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine. In some embodiments, the first base is adenine. In some embodiments, the second base is not a G, C, A, or T. In some embodiments, the second base is inosine. In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is inosine. In some embodiments, the base editor inhibits base excision repair of the edited strand. In some embodiments, the base editor protects (e.g., form base excision repair) or binds the non-edited strand. In some embodiments, the nucleobase editor comprises UGI activity. In some embodiments, the base editor comprises a catalytically inactive inosine-specific nuclease. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, *Science* 249:1527-1533; Sefton, 1989, CRC Crit. Ref. Biomed. Eng. 14:201; Buchwald et al., 1980, *Surgery* 88:507; Saudek et al., 1989, *N. Engl. J. Med.* 321:574). In another embodiment, polymeric materials can be used. (See, e.g., *Medical Applications of Controlled Release* (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, *Macromol. Sci. Rev. Macromol. Chem.* 23:61. See also Levy et al., 1985, Science 228:190; During et al., 1989, *Ann. Neurol.* 25:351; Howard et al., 1989, *J. Neurosurg.* 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., *Gene Ther.* 1999, 6:1438-47). Positively charged lipids such as N-[1-(2,3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Kits, Vectors, Cells

Some aspects of this disclosure provide kits comprising a nucleic acid construct comprising a nucleotide sequence encoding an adenosine deaminase capable of deaminating an adenosine in a deoxyribonucleic acid (DNA) molecule. In some embodiments, the nucleotide sequence encodes any of the adenosine deaminases provided herein. In some embodiments, the nucleotide sequence comprises a heterologous promoter that drives expression of the adenosine deaminase.

Some aspects of this disclosure provide kits comprising a nucleic acid construct, comprising (a) a nucleotide sequence encoding a napDNAbp (e.g., a Cas9 domain) fused to an adenosine deaminase, or a fusion protein comprising a napDNAbp (e.g., Cas9 domain) and an adenosine deaminase as provided herein; and (b) a heterologous promoter that drives expression of the sequence of (a). In some embodiments, the kit further comprises an expression construct encoding a guide nucleic acid backbone, (e.g., a guide RNA backbone), wherein the construct comprises a cloning site positioned to allow the cloning of a nucleic acid sequence identical or complementary to a target sequence into the guide nucleic acid (e.g., guide RNA backbone).

Some aspects of this disclosure provide cells comprising any of the adenosine deaminases, fusion proteins, or complexes provided herein. In some embodiments, the cells comprise a nucleotide that encodes any of the adenosine deaminases or fusion proteins provided herein. In some embodiments, the cells comprise any of the nucleotides or vectors provided herein.

The description of exemplary embodiments of the reporter systems above is provided for illustration purposes only and not meant to be limiting. Additional reporter systems, e.g., variations of the exemplary systems described in detail above, are also embraced by this disclosure.

It should be appreciated however, that additional fusion proteins would be apparent to the skilled artisan based on the present disclosure and knowledge in the art.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Data provided in the below examples describe engineering of base editors that are capable of catalyzing hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). The first deoxyadenosine deaminases were evolved to accept DNA substrates and deaminate deoxyadenosine (dA) to deoxyinosine. As one example, evolution experiments were performed using the adenosine deaminase acting on tRNA (ADAT) from *Escherichia coli* (TadA, for tRNA adenosine deaminase A), to engineer adenosine deaminases that act on DNA. Briefly, ecTadA was covalently fused to a dCas9 domain, and libraries of this fusion were assembled containing mutations in the deaminase portion of the construct. In the evolution experiments described below, several mutations in ecTadA were found to improve the ability of ecTadA to deaminate adenosine in DNA. Here the directed evolution, engineering, and characterization of an adenine base editor (ABE) that mediates the programmable conversion of A•T to G•C base pairs in bacterial and human cells is reported. Indeed, approximately half of known pathogenic single nucleotide polymorphisms are C•G to T•A transitions. The ability to convert A•T base pairs to G•C base pairs in a programmable, efficient, and precise manner therefore could substantially advance efforts to study and treat genetic diseases. Extensive evolution and engineering to maximize ABE efficiency and sequence generality resulted in seventh-generation adenine base editors, such as ABE7.10, that convert target A•T to G•C base pairs efficiently (averaging 53% across 17 genomic sites in human cells) with very high product purity (typically >99%) and very low rates of indels comparable to those of untreated cells (typically ≤0.1%). It is shown in the examples that follow that ABET variants introduce point mutations much more efficiently and cleanly than a current Cas9 nuclease-mediated HDR method, induce less off-target genome modification than Cas9 nuclease, and can be used both to correct disease-associated SNPs, and to introduce disease-suppressing SNPs in cultured human cells.

The formation of uracil and thymine from the spontaneous hydrolytic deamination of cytosine and 5-methylcytosine, respectively,[1,2] occurs an estimated 100-500 times per cell per day in humans[1] and can result in C•G to T•A mutations, accounting for approximately half of all known pathogenic SNPs (FIG. 1A). The ability to convert A•T base pairs to G•C base pairs at target loci in the genomic DNA of unmodified cells therefore could enable the correction of a substantial fraction of human SNPs associated with disease Base editing is a form of genome editing that enables the direct, irreversible conversion of one base pair to another at a target genomic locus without requiring double-stranded DNA breaks (DSBs), homology-directed repair (HDR) processes, or donor DNA templates.[3-5] Compared with standard genome editing methods to introduce point mutations, base editing can proceed more efficiently[6], and with far fewer undesired products such as stochastic insertions or deletions (indels) or translocations.[4,6-8]

The most commonly used base editors are third-generation designs (BE3) that consist of (i) a catalytically impaired CRISPR-Cas9 mutant that cannot make DSBs, (ii) a single-strand-specific cytidine deaminase that converts C to uracil (U) within a small window (~5 nucleotides) in the single-stranded DNA bubble created by Cas9, (iii) a uracil glycosylase inhibitor (UGI) that impedes uracil excision and downstream processes that decrease base editing efficiency and product purity[9], and (iv) nickase activity to nick the non-edited DNA strand, directing cellular mismatch repair to replace the G-containing DNA strand[6,9]. Together, these components enable efficient and permanent C•G to T•A base pair conversion in bacteria, yeast[4,10] plants[11,12], zebrafish[13], mammalian cells[14,15], mice[16,17], and even human embryos.[18,19] Base editing capabilities have expanded through the development of base editors with different protospacer-adjacent motif (PAM) compatibilities, narrowed editing windows[7], enhanced DNA specificity[8], and small-molecule dependence[20]. Fourth-generation base editors (BE4 and BE4-Gam) further improve C•G to T•A editing efficiency and product purity.[9]

To date, all reported base editors mediate C•G to T•A conversion. In this study, protein evolution and engineering were used to develop a new class of adenine base editors (ABEs) that convert A•T to G•C base pairs in DNA in bacteria and human cells. Seventh-generation ABEs such as ABE7.10 (FIG. 7) convert A•T to G•C at a wide range of target genomic loci in human cells with a typical efficiency of ~50% and with a very high degree of product purity (>99%), exceeding the typical performance characteristics of BE3. ABEs greatly expand the scope of base editing and, together with previously described base editors, enable the programmable installation of all four transition mutations (C to T, A to G, T to C, and G to A) in the genomes of living cells.

Example 1—Evolution of an Adenine Deaminase that Operates on DNA

Figure 1B:
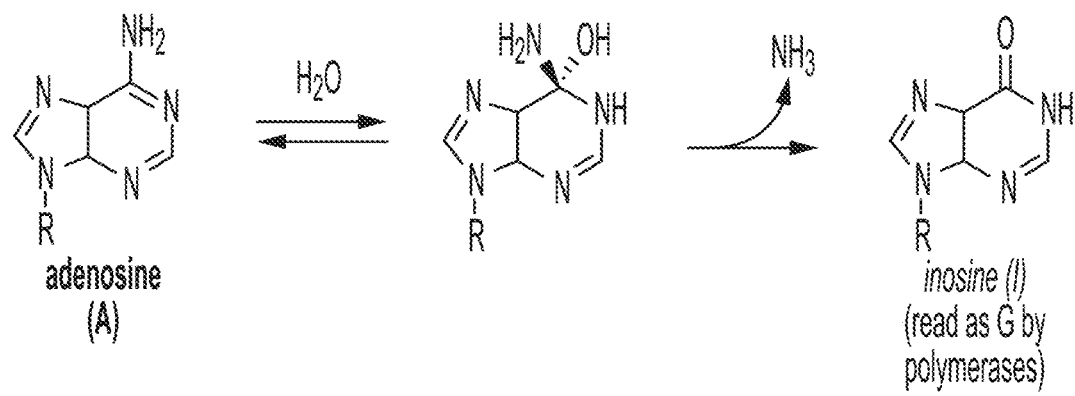
Figure 1C:
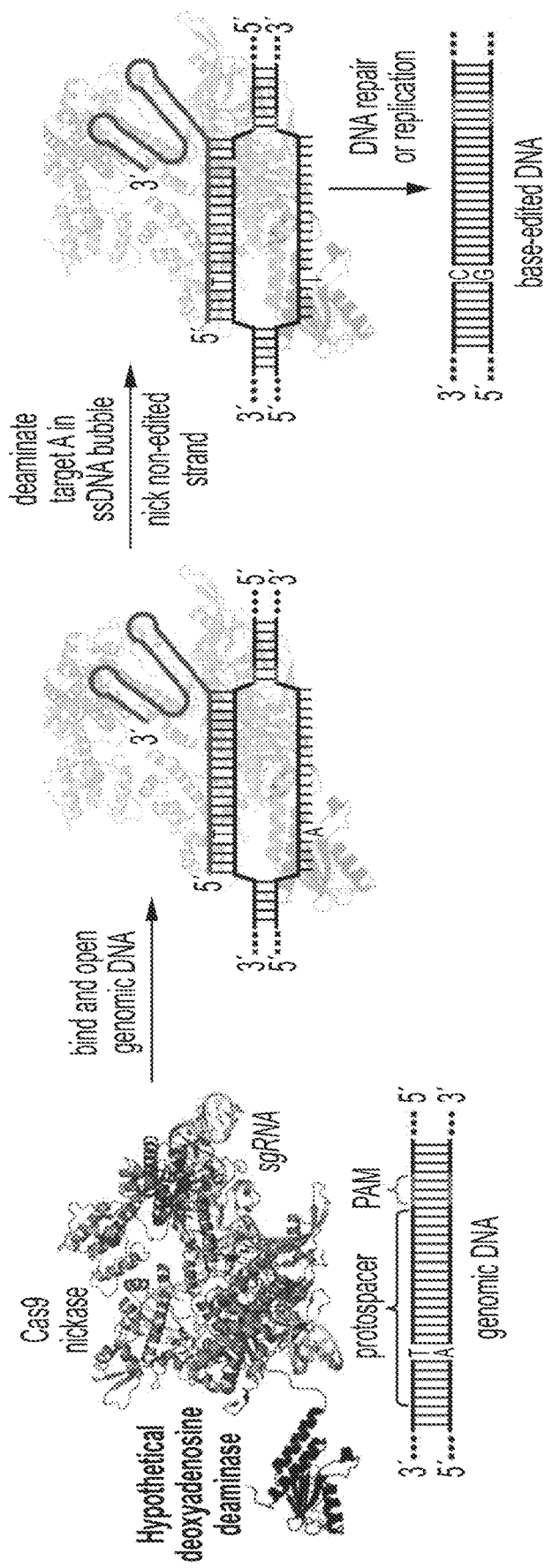
Figures 8A, 8B:
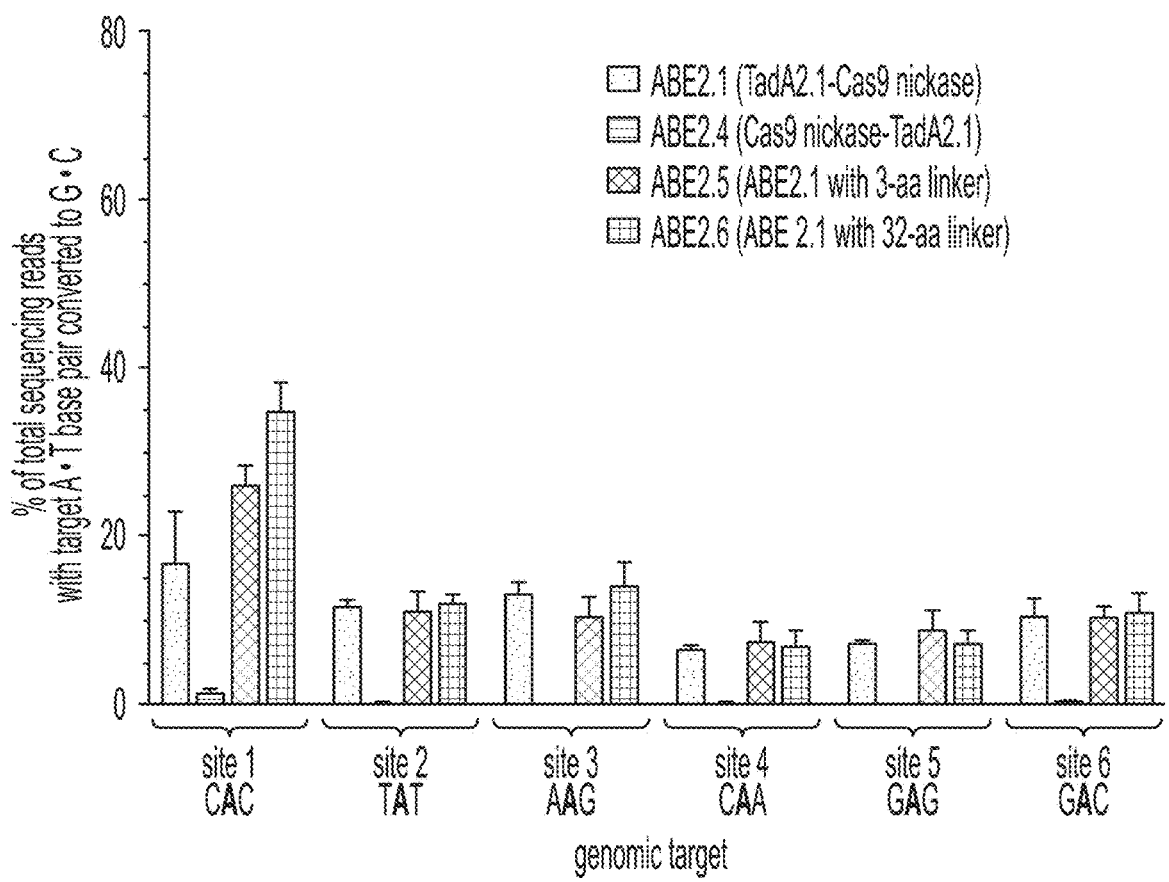
FIGS. 8A to 8D show base editing efficiencies of additional early-stage ABE variants.

The hydrolytic deamination of adenosine yields inosine (FIG. 1B). Within the constraints of a polymerase active site, inosine pairs most stably with C and therefore is read or replicated as G[21]. While replacing the cytidine deaminase domain of an existing base editor with an adenine deaminase could, in theory, provide an ABE (FIG. 1C), no enzymes are known to deaminate adenine in DNA. Although all reported examples of adenine deaminases process either free adenine, free adenosine, adenosine in RNA or in mispaired RNA: DNA heteroduplexes,[22] or, curiously, catalyze C to U formation on single-stranded DNA[23], the present efforts were begun by replacing the APOBEC1 component of BE3 with natural adenine deaminases including E. coli TadA[24-26], human ADAR[27,28], mouse ADA[29], and human ADAT2[30,31] (Supplementary Sequences 1) to test the possibility that a high effective molarity of single-stranded DNA might overcome their poor activity on DNA. Unfortunately, when plasmid DNA constructs encoding these adenine deaminase-Cas9 D10A nickase fusions were transfected into HEK293T cells together with a corresponding single-guide RNA (sgRNA), no significant A•T to G•C editing was observed above that of untreated cells (FIG. 8A). These results suggest that the inability of the natural adenine deaminase enzymes tested to process DNA precludes their direct use in an ABE.

Given these results, an adenine deaminase variant that accepts DNA as a substrate starting from a naturally occurring RNA adenine deaminase was sought to be evolved. A bacterial selection for base editing was developed by creating antibiotic resistance genes that contain point mutations at critical positions (FIG. 23 and Supplementary Sequences 2). Reversion of these mutations by base editors enables bacterial survival in the presence of antibiotic. To validate the selection, a bacterial codon optimized version of BE2[6] (APOBEC1 cytidine deaminase fused to dCas9 and UGI) was used, since bacteria lack nick-directed mismatch repair machinery that enables more efficient base editing by BE3[32]. After optimizing target mutation choice, promoter strength, selection plasmid copy number, incubation times, and antibiotic selection stringency, successful rescue of a defective chloramphenicol acetyl transferase (Cam$^R$) containing an A•T to G•C mutation at a catalytic residue (H193R) by BE2 and a sgRNA programmed to direct base editing to the inactivating mutation was observed, resulting in a chloramphenicol minimum inhibitory concentration (MIC) increase from 1 µg/mL to 32 µg/mL. DNA sequencing confirmed that bacterial cells surviving selection contained the C•G to T•A mutation restoring Cam$^R$ function.

Next the selection plasmid was adapted for ABE activity by introducing a C•G to T•A mutation in the Cam$^R$ gene, creating an H193Y substitution (FIG. 23 and Supplementary Sequences 2) that confers an MIC of 1 µg/mL chloramphenicol. A•T to G•C conversion at the H193Y mutation should restore chloramphenicol resistance, thereby linking ABE activity to bacterial survival in the presence of chloramphenicol.

The previously described base editors[6-9] exploit the use of cytidine deaminase enzymes that operate on single-stranded DNA and reject double-stranded DNA. This single-stranded DNA requirement is critical to focus deaminase activity on a small window of nucleotides within the single-stranded bubble created by Cas9, minimizing undesired deamination events beyond the target nucleotide(s). TadA is a tRNA adenine deaminase[24] that converts adenine to inosine (I) in the single-stranded anticodon loop of tRNA$^{Arg}$. E. coli TadA shares homology with the APOBEC family of enzymes[33] used in the original base editors, and structural studies revealed that some ABOBECs bind single-stranded DNA in a conformation that resembles that of tRNA bound to TadA[33]. TadA does not require small-molecule activators (in contrast with ADAR[34]) and acts on polynucleic acid (unlike ADA[29]). Based on these considerations, E. coli TadA was chosen as the starting point of the efforts to evolve a DNA adenine deaminase.

Figures 2A, 2B:
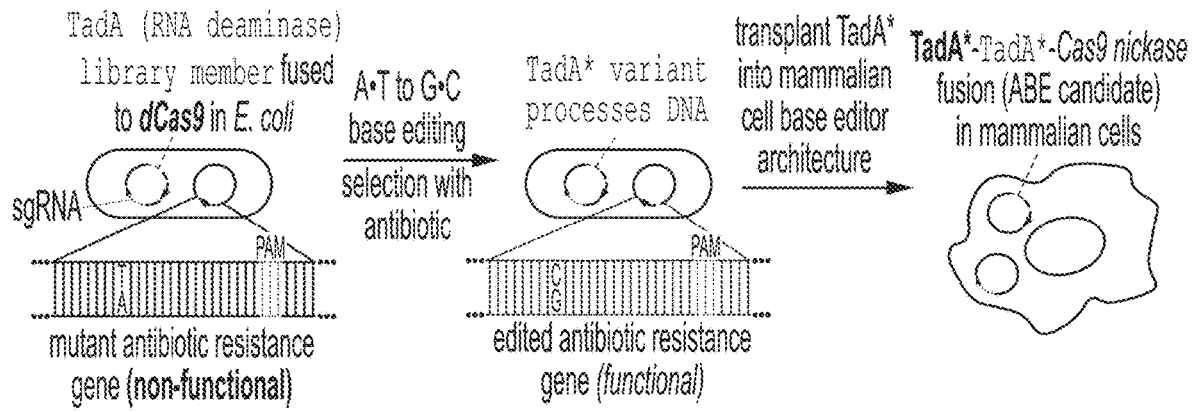
FIGS. 2A to 2C show protein evolution and engineering of ABEs.
Figure 2C:
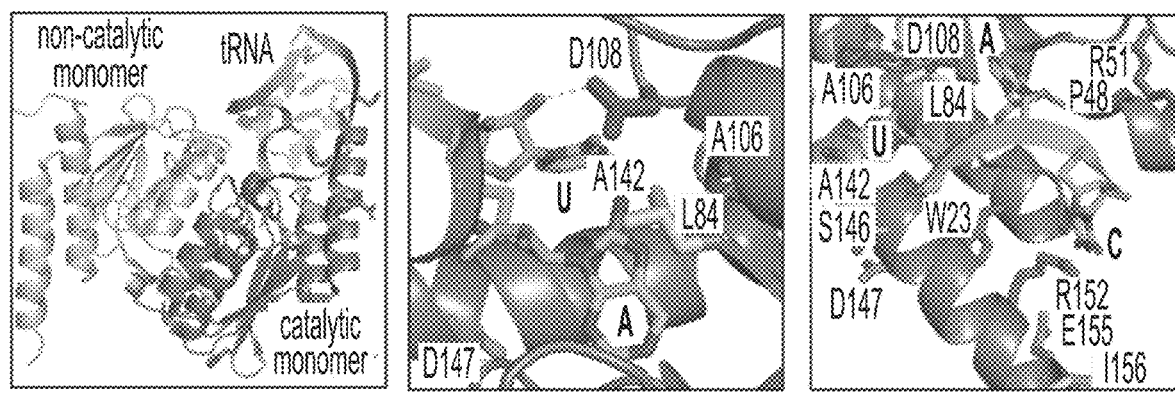

Unbiased plasmid libraries of ecTadA-dCas9 fusions containing mutations only in the adenine deaminase portion of the construct to avoid altering the favorable properties of the Cas9 portion of the editor were created. The resulting plasmid libraries were transformed into E. coli harboring the Cam$^R$ H193Y selection and ~5.0×10$^6$ transformants were plated on media containing 2 to 16 µg/mL chloramphenicol (FIG. 2A). Surviving colonies were strongly enriched for TadA mutations A106V and D108N (FIG. 2B). Sequence alignment of the evolved E. coli TadA with S. aureus TadA, a homolog for which a structure complexed with tRNA$^{Arg}$ has been reported[35], predicts that the side-chain of D108 makes a hydrogen bond with the 2'-OH group of the ribose in the uridine nucleotide immediately upstream of the substrate adenosine (FIG. 2C). Mutations at D108 likely abrogate this hydrogen bond and thereby decrease the energetic opportunity cost of accepting DNA in the substrate-binding site. DNA sequencing confirmed that all bacterial clones surviving the selection showed substantial A•T to G•C reversion at the targeted site in Cam$^R$. Collectively, these results indicate that mutations at or near TadA D108 enable TadA to perform adenine deamination on DNA substrates.

Figure 3A:
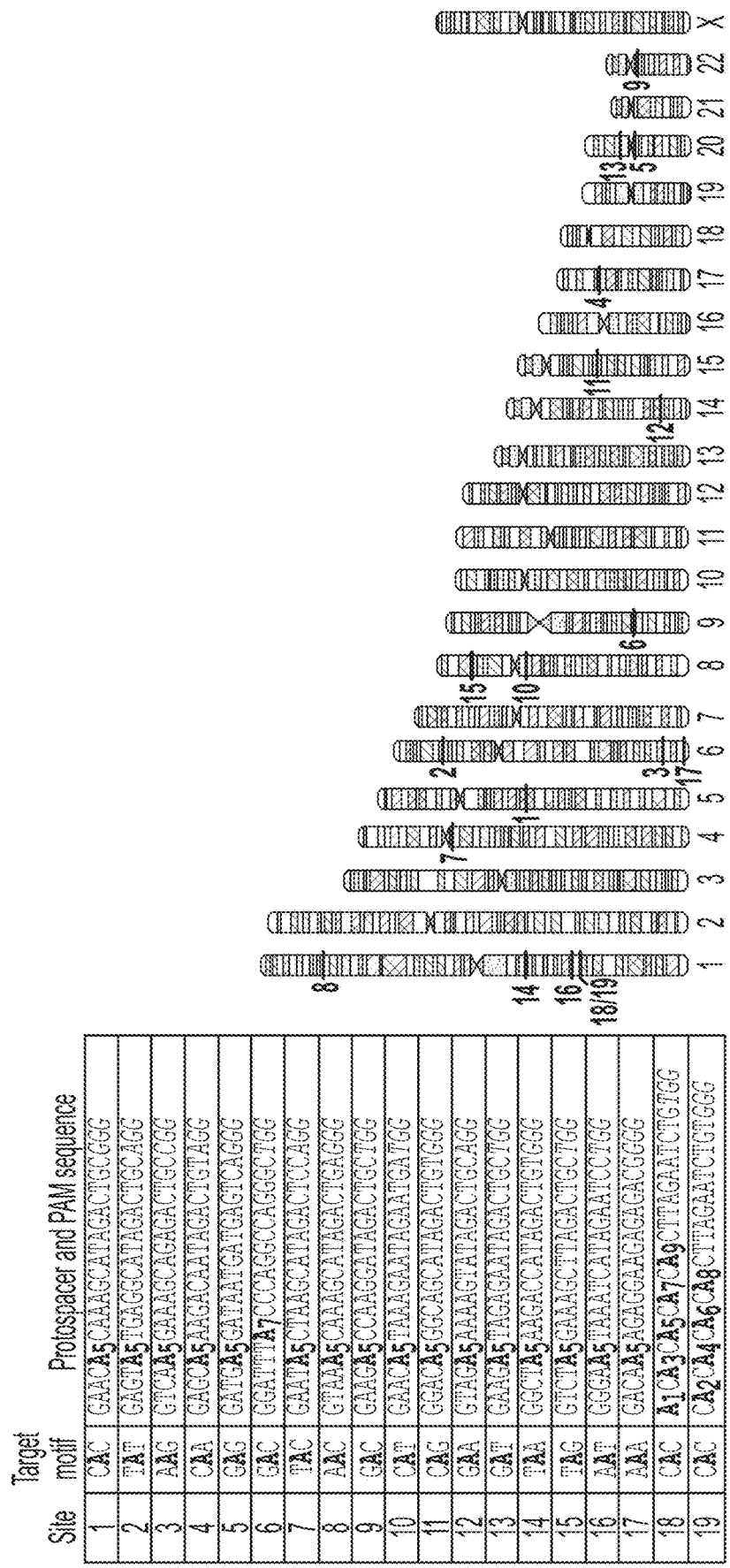
FIGS. 3A to 3C show early- and mid-stage evolved ABEs mediate A•T to G•C base editing at human genomic DNA sites.
Figure 3B:
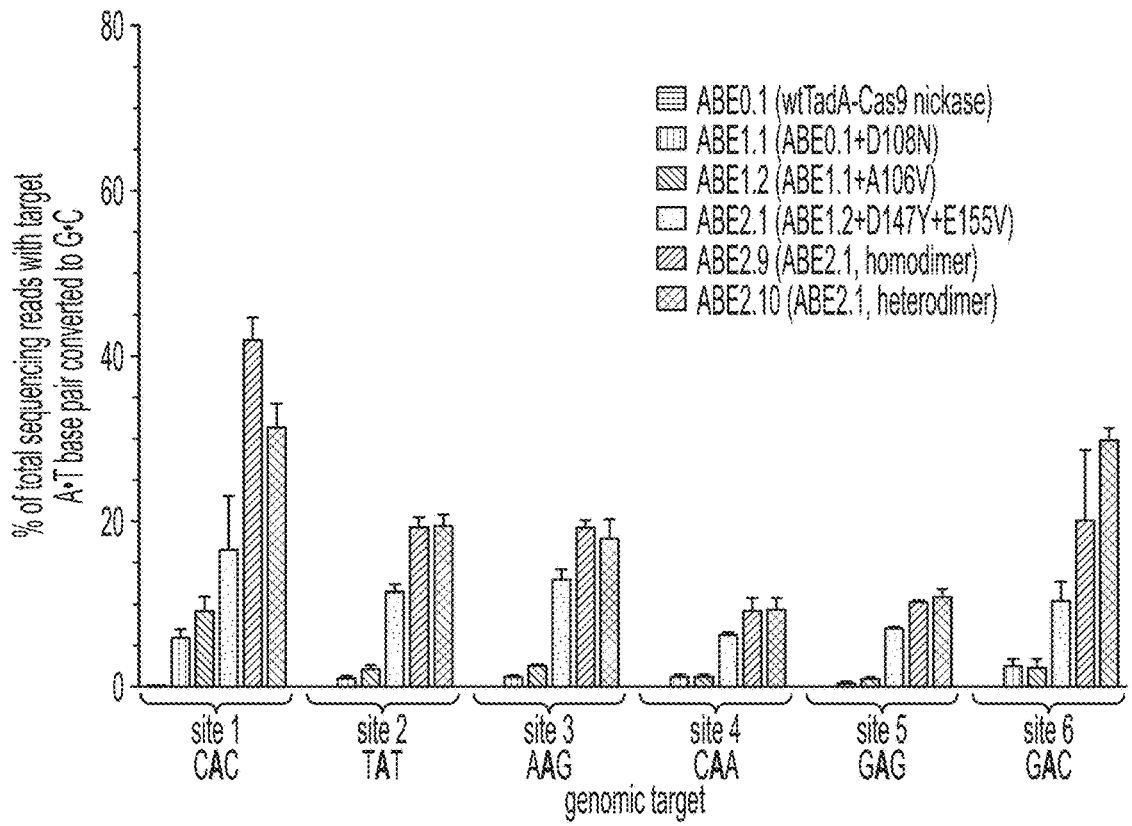

The TadA A106V and D108N mutations were incorporated into a mammalian codon-optimized TadA-Cas9 nickase fusion construct that replaces the dCas9 used in bacterial evolution with the Cas9 D10A nickase used in BE3 to manipulate cellular DNA mismatch repair to favor desired base editing outcomes, and adds a C-terminal nuclear localization signal (NLS). Rhe resulting TadA*-XTEN-nCas9-NLS construct, where TadA* represents an evolved TadA variant and XTEN is a 16-amino acid linker used in BE3[6], was designated as ABE1.2. Transfection of plasmids expressing ABE1.2 and sgRNAs targeting six human genomic sites (FIG. 3A) resulted in very low, but observable A to G editing efficiencies (3.2±0.88%; all editing efficiencies are reported as mean±SD of three biological replicates without enrichment for transfected cells unless otherwise noted) across six diverse target sites in the human genome (FIG. 2A) at or near protospacer position 5, counting the PAM as positions 21-23 (FIG. 3B). These data confirmed that an ABE capable of catalyzing low levels of A•T to G•C conversion emerged from the first round of protein evolution and engineering.

Example 2—Improved Deaminase Variants and ABE Architectures

The editing efficiency of ABE1.2 was sought to be improved through a second round of evolution. An unbiased library of ABE1.2 variants was generated as before, and the resulting TadA*1.2-dCas9 mutants were challenged in bacteria with higher concentrations of chloramphenicol (16 to 128 µg/mL) than was used in round 1 (FIGS. 22 and 23). From this second round of evolution, two mutations, D147Y and E155V, predicted to lie in a helix adjacent to the substrate in TadA, were identified (FIG. 2C). In mammalian cells, ABE2.1 (ABE1.2+D147Y+E155V) exhibited 2- to 7-fold higher activity than ABE1.2 at the six genomic sites tested, resulting in an average of 11±2.9% A•T to G•C base editing (FIG. 3B).

Next, ABE2.1 editing efficiencies were sought to be improved through additional protein engineering. Fusing the TadA(2.1)* domain to the C-terminus of Cas9 nickase, instead of the N-terminus, resulted in the complete loss of editing activity (FIGS. 7 and 8B), consistent with previous findings with BE3[6]. Linker lengths were also varied between TadA(2.1)* and Cas9 nickase. An ABE2 variant (ABE2.6)

with a linker twice as long (32 amino acids, (SGGS)$_2$-XTEN-(SGGS)$_2$,) as the original 16-residue XTEN linker in ABE2.1 offered modestly higher editing efficiencies compared with ABE2.1, now averaging 14±2.4% across the six genomic loci tested (FIGS. 7 and 8B).

Figures 8C, 8D:
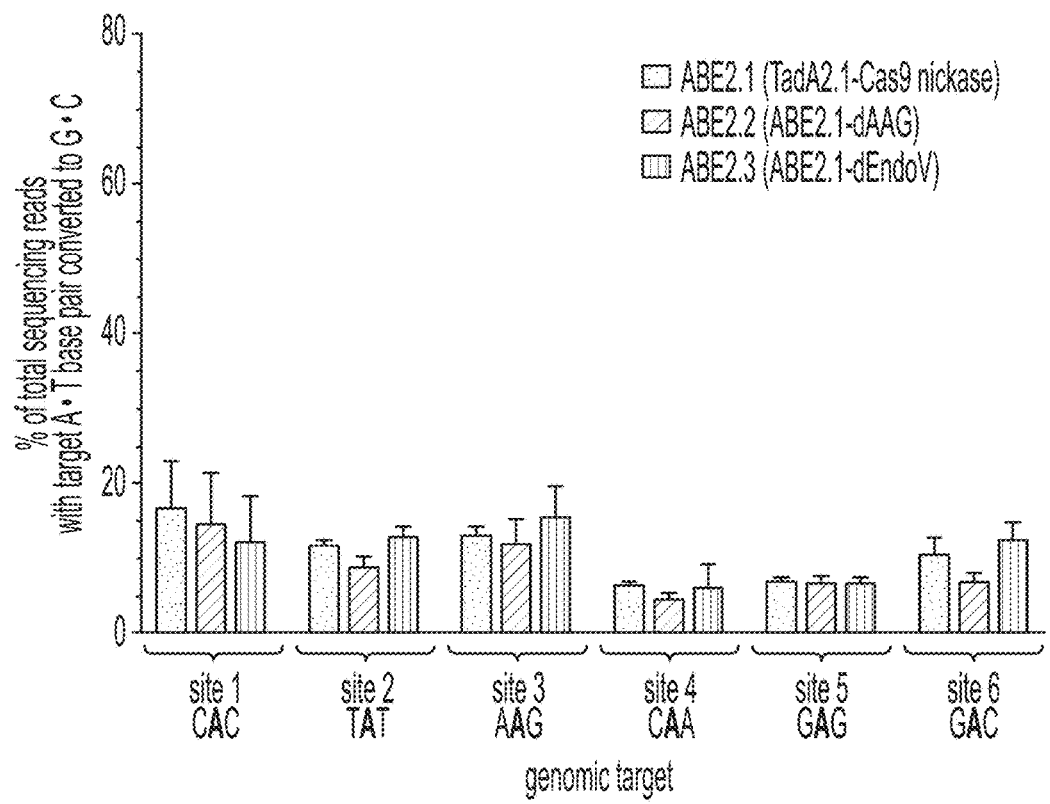
Figure 11A:
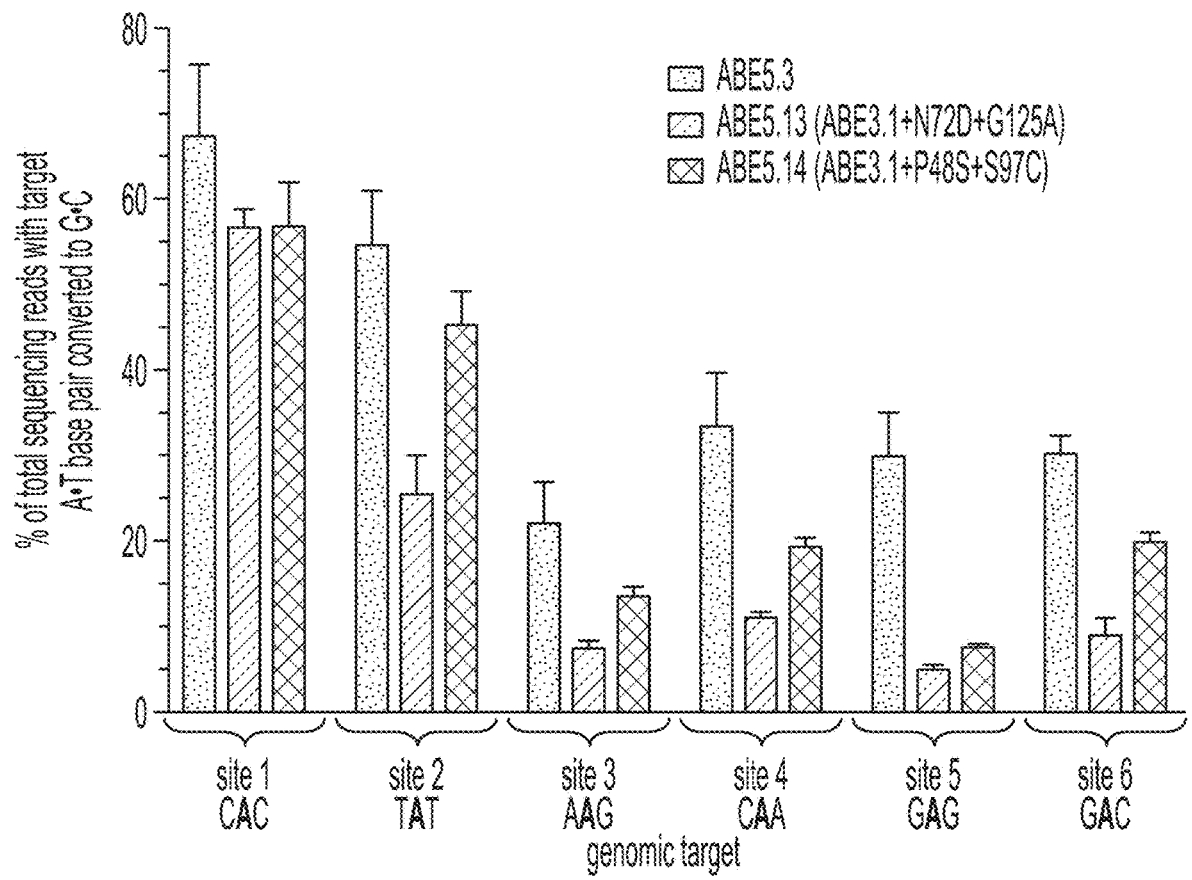
FIGS. 11A and 11B show base editing efficiencies of additional ABE5 variants.
Figure 11B:
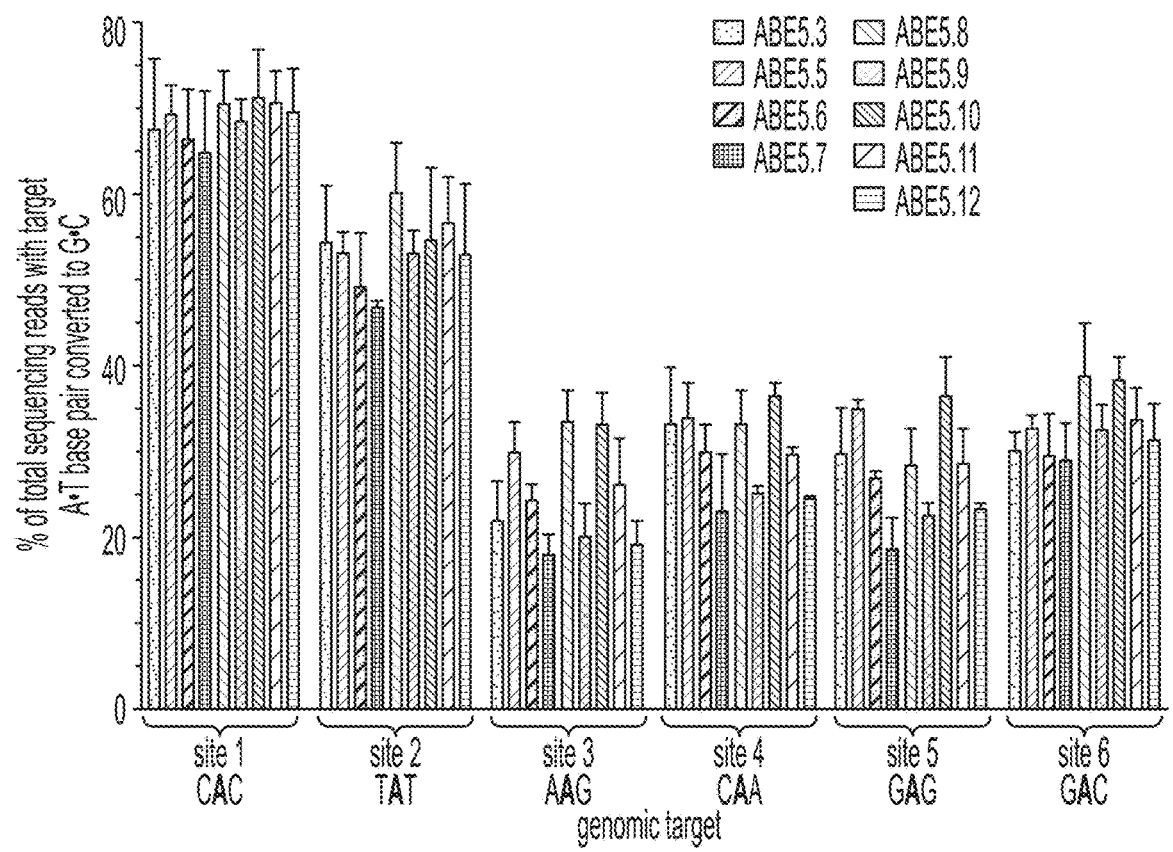

Analogous to the mechanism by which uracil N-glycosylase (UNG) catalyzes the removal of uracil from DNA and initiates base excision repair, alkyl adenine DNA glycosylase (AAG) catalyzes the cleavage of the glycosidic bond of inosine in DNA[36,37]. To test if inosine excision impedes ABE performance, ABE2 variants designed to minimize potential sources of inosine base excision repair (BER) were created. Given the absence of known protein inhibitors of AAG, endogenous AAG was attempted to be blocked from accessing the inosine intermediate by separately fusing to the C-terminus of ABE2.1 catalytically inactivated versions of enzymes involved in inosine binding or removal: human AAG (inactivated with a E125Q mutation[38]), or E. coli Endo V (inactivated with a D35A mutation[39]). Neither ABE2.1-AAG(E125Q) (ABE2.2) nor ABE2.1-Endo V(D35A) (ABE2.3) exhibited altered A•T to G•C editing efficiencies in HEK293T cells compared with ABE2.1 (FIGS. 7 and 8C). Indeed, using ABE2.1 in Hap1 cells lacking AAG did not result in increases in base editing efficiency, increases in product purity, or decreases in indel frequency compared with Hap1 cells containing wild-type AAG (FIG. 8D). Moreover, ABE2.1 induced virtually no indels (≤0.1%) or A•T to non-G•C products (≤0.1%) at the six loci tested, consistent with inefficient excision of the inosine intermediate (FIGS. 11A to 11B). Taken together, these observations strongly suggest that cellular repair of inosine intermediates created by ABEs is inefficient, obviating the need to subvert processes such as BER. This situation contrasts with that of BE3 and BE4, which are strongly dependent on inhibiting uracil excision to maximize base editing efficiency and product purity, and to suppress indel formation[6,9].

Figure 10A:
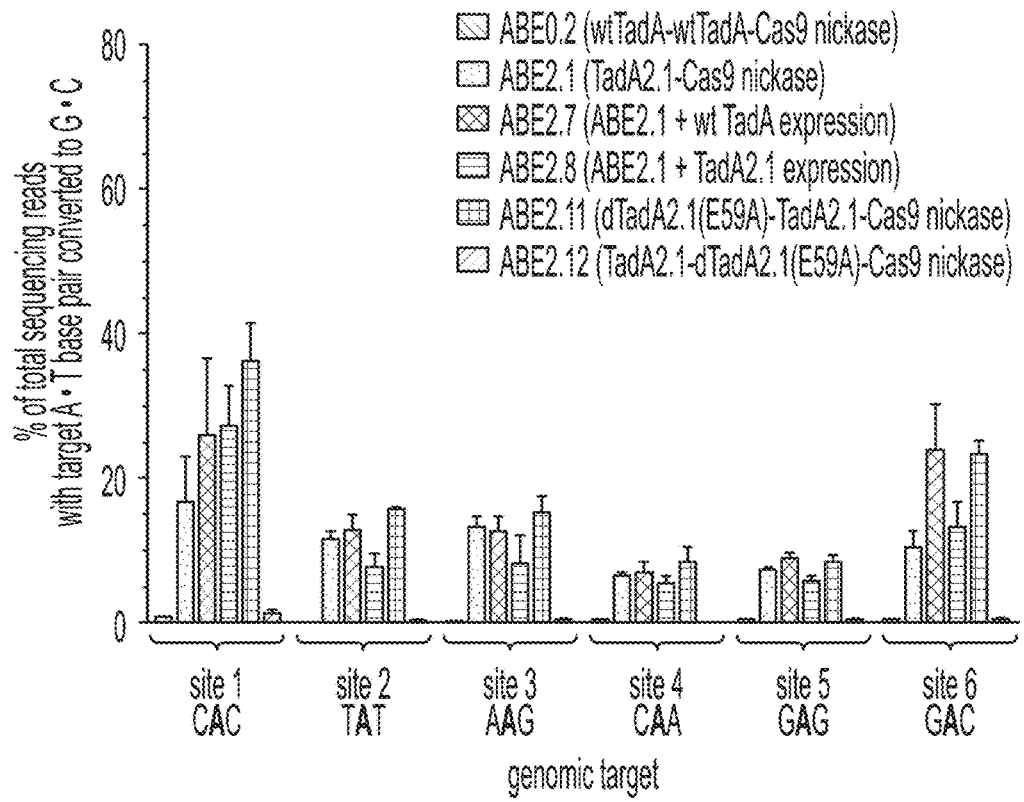
FIGS. 10A to 10C show base editing efficiencies of additional ABE2 and ABE3 variants, and the effect of adding A142N to TadA*-dCas9 fusions on antibiotic selection survival in E. coli.

As a final ABE2 engineering study, the role of the TadA* dimerization state on base editing efficiencies in human cells was explored. In its native form, TadA operates as a homodimer, with one monomer catalyzing A to I deamination, and the other monomer acting as a docking station for the tRNA substrate. During selection in E. coli, it is speculated that endogenous TadA serves as the non-catalytic monomer. In mammalian cells, it is hypothesized that tethering an additional wild-type or evolved TadA monomer might improve editing efficiencies by minimizing reliance on intermolecular ABE dimerization. Indeed, co-expressing with ABE2.1 either wild-type TadA or TadA*2.1 to promote in trans ABE2.1:TadA or ABE2.1:TadA*2.1 dimer formation (ABE2.? and ABE2.8, respectively), as well as direct fusion of either evolved or wild-type TadA to the N-terminus of ABE2.1 (ABE2.9 and ABE2.10, respectively), substantially improved editing efficiencies (FIGS. 3B, 7, and 10A). A fused TadA-ABE2.1 architecture (ABE2.9) was identified to offer the highest editing efficiencies (averaging 20±3.8% across the six genomic loci, and a 7.6±2.6-fold average improvement at each site over ABE1.2) and was used in all subsequent experiments (FIGS. 2B and 3B). A control ABE variant containing two wild-type TadA domains and no evolved TadA* domains did not result in A•T to G•C editing at the six genomic sites tested (FIG. 10A), confirming that dimerization alone was insufficient to mediate ABE activity.

Since these results implicated TadA dimerization as an important component of ABE editing efficiency, it was determined which of the two TadA subunits within the TadA-ABE2 fusion was responsible for A to I catalysis. An inactivating E59A mutation[24] was introduced into either the N-terminal or the internal TadA monomer of ABE2.9, generating ABE2.11 or ABE2.12, respectively. The variant with an inactivated N-terminal TadA subunit (ABE2.11) demonstrated comparable editing efficiencies to ABE2, whereas the variant with an inactivated internal TadA subunit lost all editing activity (FIGS. 7 and 10A). These results establish that the internal TadA subunit is responsible for A to I catalysis.

Example 3—ABEs that Efficiently Edit a Subset of Targets

Figure 3C:
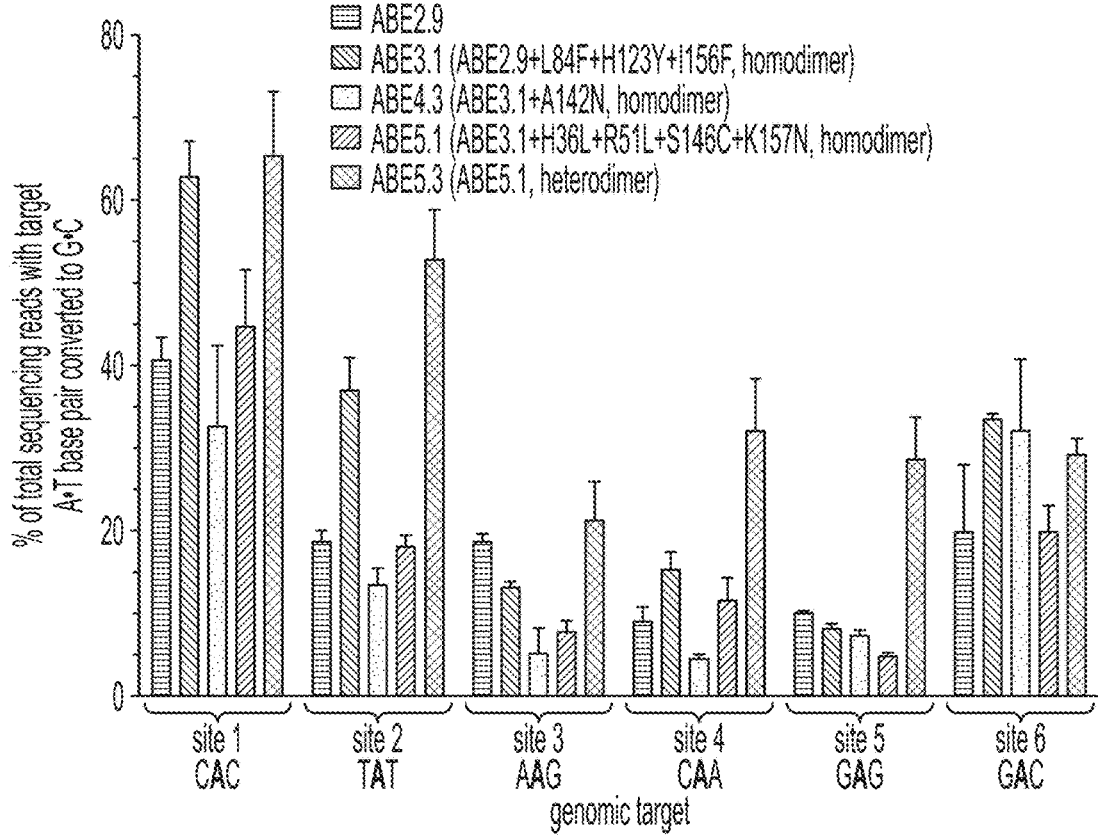
Figure 10B:
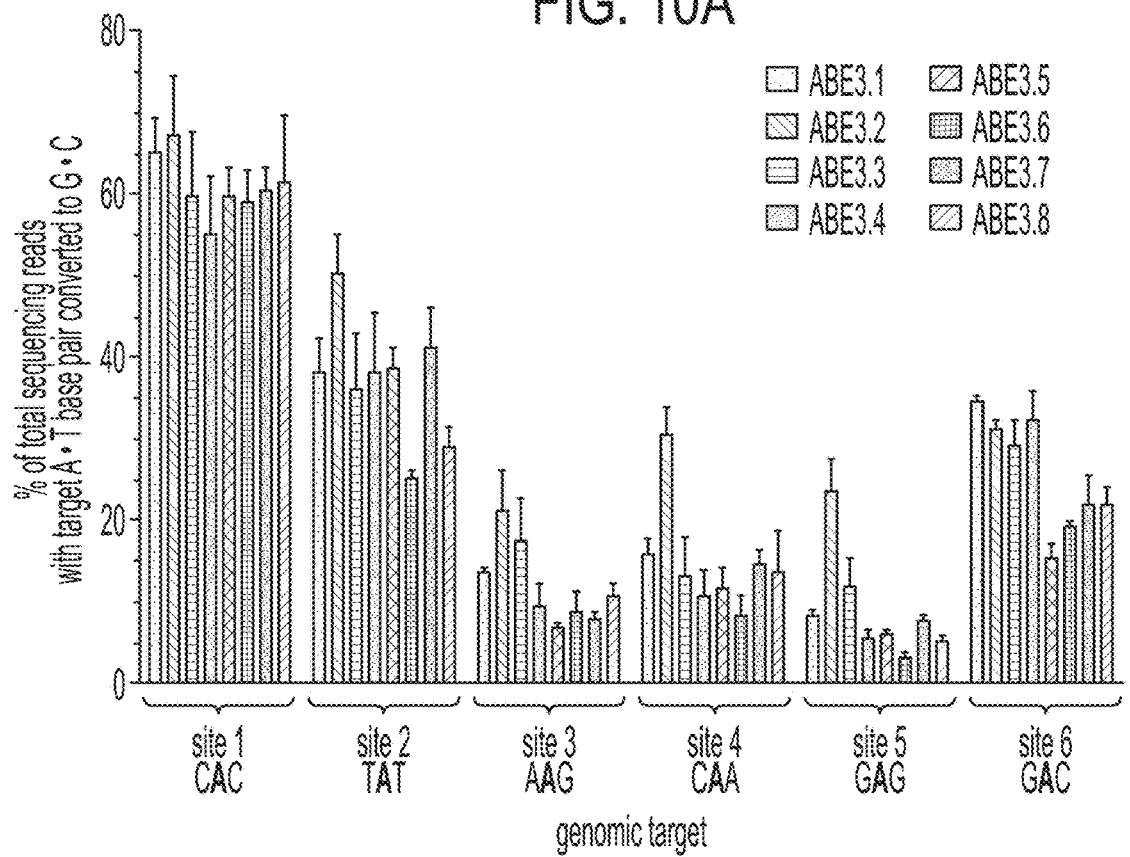

Next, a third round of bacterial evolution was performed starting with TadA*2.1-dCas9 (relying on in trans dimerization with endogenous E. coli TadA or with itself) to further increase A•T to G•C editing efficiencies. The stringency of the selection was increased by introducing two early stop codons (Q4stop and W15stop) in the kanamycin resistance gene (Kan$^R$, aminoglycoside phosphotransferase, FIG. 23 and Supplementary Sequences 2). Each of the mutations required an A•T to G•C reversion to correct the premature stop codon. The MIC for host cells harboring the evolution round 3 selection plasmid was ~8 μg/mL kanamycin and base editing of both Kan$^R$ mutations on the same plasmid is required to restore kanamycin resistance (FIG. 23). A library of TadA*2.1-dCas9 variants containing mutations in the TadA domain were subjected to this higher stringency selection in the presence of 16 to 128 μg/mL kanamycin, resulting in the strong enrichment of three new TadA mutations: L84F, H123Y, and I157F. These mutations were imported into the ABE2.9 mammalian construct to generate ABE3.1 (FIG. 2B). In HEK293T cells, ABE3.1 resulted in editing efficiencies averaging 29±2.6% across the six tested sites, a 1.6-fold average increase in A•T to G•C conversion at each site over ABE 2.9, and a 11-fold average improvement over ABE1.2 (FIG. 3C). Longer (64- or 100-amino acid) linkers between the two TadA monomers, or between TadA* and Cas9 nickase, were also tested and negative effects on editing efficiencies compared to ABE3.1 were observed (FIGS. 7 and 10B).

Although ABE3.1-mediated base editing efficiencies were high at some sites, such as site 1 (65±4.2% conversion), which placed the edited A at protospacer position 5 in a CAC context, for other sites, such as site 5, which placed the edited A in a GAG context, editing efficiencies were much lower (8.3±0.67% conversion) (FIG. 3C). The results from six genomic loci with different sequence contexts surrounding the target A suggest that ABEs from rounds 1-3 strongly preferred target sequence contexts of YAC, where Y=T or C. This sequence context preference was likely inherited from the substrate specificity of native E. coli TadA, which deaminates the A in the UAC context of the anticodon loop of tRNA$^{Arg}$. The utility of an ABE for base editing applications would be greatly limited, however, by such a target sequence restriction.

Figure 10C:
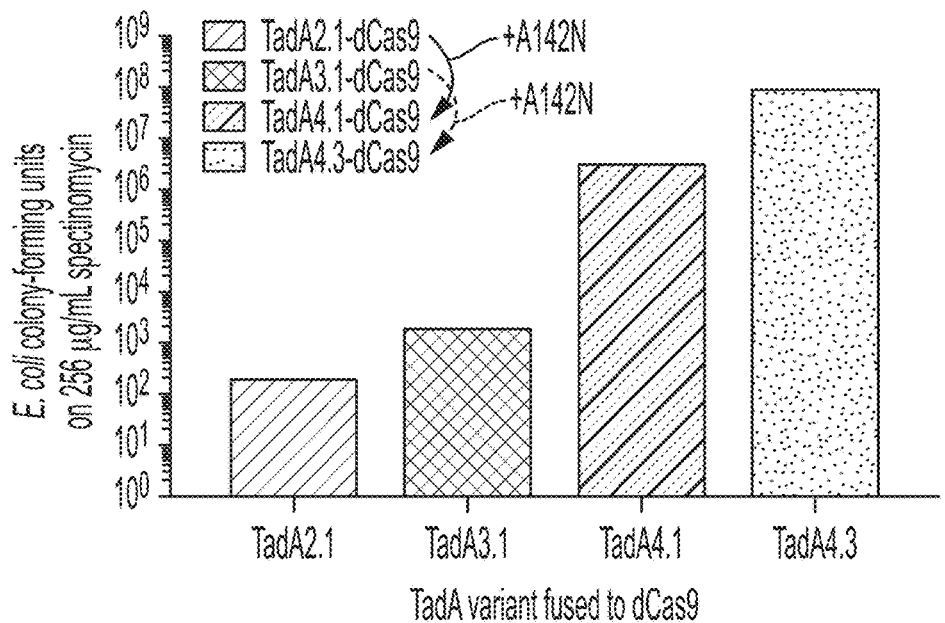

To overcome the YAC sequence preference of ABE3.1, a fourth evolution campaign focusing mutagenesis at TadA residues predicted to interact with the nucleotides upstream and downstream of the target A was initiated. Inspection of the S. aureus TadA-tRNA co-crystal structure[35] revealed residues that directly contact the anticodon loop of the tRNA substrate, corresponding to E. coli TadA E25, R26, R107, A142, and A143. TadA*2.1-dCas9 libraries (FIG. 22) containing randomized residues at these positions were subjected to a new bacterial selection in which A•T to G•C conversion of a non-YAC target (GAT, which causes a T89I mutation in the spectinomycin resistance protein) restores antibiotic resistance (FIG. 23 and Supplementary Sequences 2). Library members in cells harboring the selection plasmid (MIC of ~32 µg/mL spectinomycin, FIG. 23), were challenged with high concentrations of spectinomycin (64 to 512 µg/mL). Surviving bacteria strongly converged on the TadA mutation A142N. Although apparent A•T to G•C base editing efficiency in bacterial cells with TadA*4.3-dCas9 (TadA*3.1+A142N-dCas9) was higher than with TadA*3.1-dCas9 as judged by spectinomycin MIC (FIG. 10C), ABE4.3 generally exhibited decreased base editing efficiencies (averaging 16±5.8%) compared with ABE3.1 in mammalian cells (FIGS. 2B and 3C). It was hypothesized that the A142N mutation may benefit base editing in a context-dependent manner, and revisited its inclusion in later rounds of evolution (see below).

A fifth round of evolution was performed to increase ABE catalytic performance and broaden target sequence compatibility. A library of TadA*3.1-dCas9 variants was generated containing unbiased mutations throughout the TadA* domain as before (FIG. 22). To favor ABE constructs with faster kinetics, this library was subjected to the Cam$^R$ H193Y selection with higher doses of chloramphenicol (≥128m/mL) after allowing ABE expression for only half the duration (7 h) of the previous rounds of evolution (~14 h). Surviving clones contained a variety of mutations near the N- and C-terminal domain of TadA. Surprisingly, importing a consensus set of these mutations (H36L, R51L, S146C, and K157N) into ABE3.1, creating ABE5.1, decreased overall editing efficiencies in HEK293T cells by 1.7±0.29-fold (FIGS. 2B and 3C).

Since ABE5.1 included seven mutations since the previous dimerization state experiments on ABE2.1, it was speculated that the accumulation of these new mutations may impair the ability of the non-catalytic N-terminal TadA subunit to play its structural role in mammalian cells. In E. coli, endogenous wild-type TadA monomer is provided in trans, potentially explaining the disconnect between bacterial selection phenotypes and mammalian cell editing efficiencies. Therefore, the effect of using wild-type TadA instead of evolved TadA* variants in the N-terminal, non-catalytic TadA domain of ABE5 variants was examined. These studies revealed that a heterodimeric construct comprised of a wild-type E. coli TadA fused to an internal evolved TadA* (ABE5.3) exhibited greatly improved editing efficiencies compared to the homodimeric ABE5.1 with two identical evolved TadA* domains. ABE5.3 editing efficiencies across the six genomic test sites averaged 39±5.9%, with an average improvement at each site of 2.9±0.78-fold relative to ABE5.1 (FIGS. 2B and 3C). Compared with ABE3.1, ABE5.3 increased editing efficiencies by an average of 1.8±0.39-fold at each tested site. Importantly, ABE5.3 also showed broadened sequence compatibility that now enabled 22-33% editing of non-YAC targets including site 3 (AAG), site 4 (CAA), site 5 (GAG), and site 6 (GAC) (FIG. 3C).

Concurrently, a round 5 library was subjected to the non-YAC spectinomycin selection used in round 4. Although no highly enriched mutations emerged, new mutations from two genotypes emerging from this selection, N72D+G125A; and P48S+S97C (FIG. 7), were included in subsequent library generation steps. The simple addition of these mutations to ABE3.1 (generating ABE5.13 and ABE5.14, respectively) did not improve editing efficiencies (FIGS. 7 and 11A).

Since the ABE3 linker studies demonstrated that linkers much longer than 32 amino acids decreased ABE activity (FIGS. 7 and 10B), a more refined approach was taken to optimize ABE5 linkers. Eight heterodimeric wild-type TadA-TadA* ABE5.3 variants (ABE5.5 to ABE5.12) containing 24-, 32-, or 40-residue linkers between the TadA domains or between TadA and Cas9 nickase were tested in HEK293T cells, resulting in no obvious improvements in base editing efficiency (FIGS. 7 and 11B). All subsequent studies thus used the ABE5.3 architecture containing a heterodimeric wtTadA-TadA*-Cas9 nickase with two 32-residue linkers.

Example 4—Highly Active ABEs with Broad Sequence Compatibility

Figure 4A:
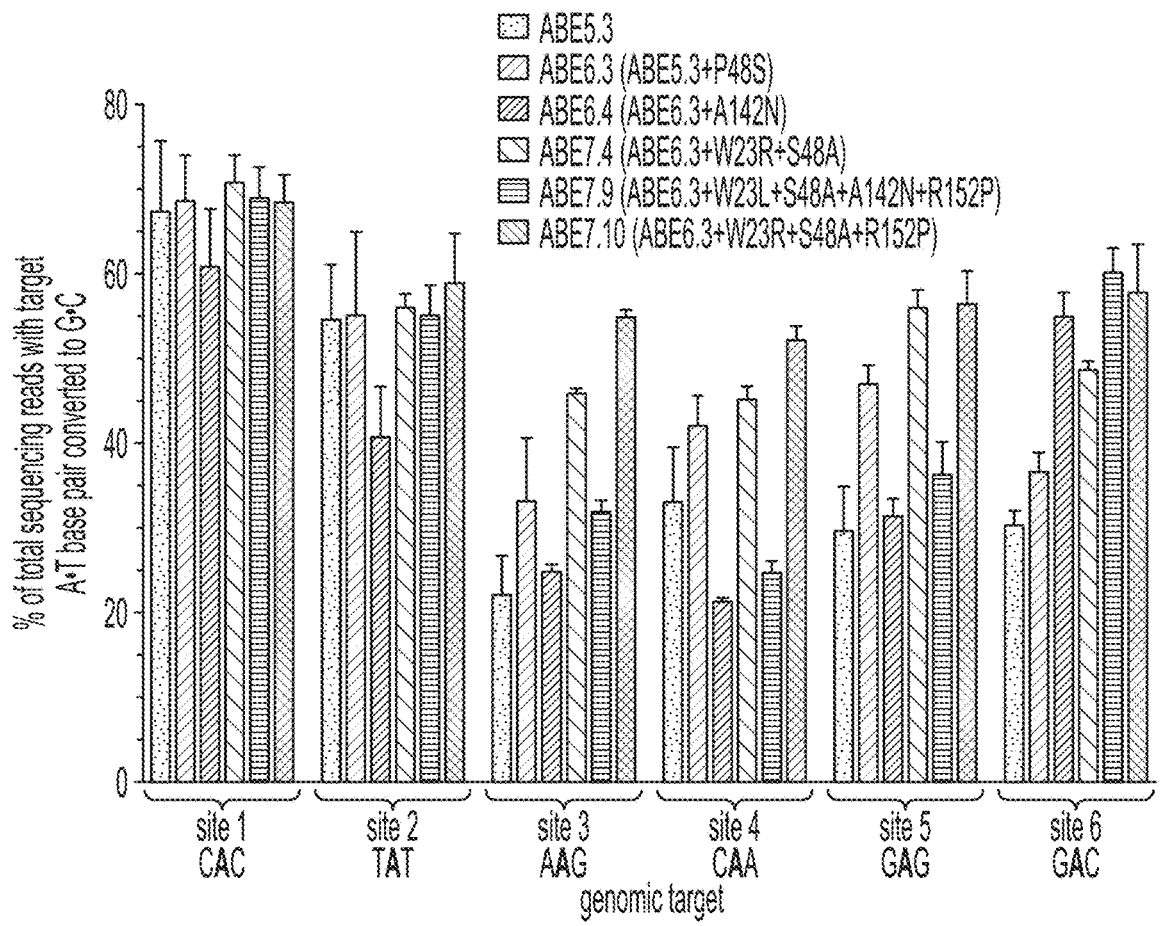
FIGS. 4A and 4B show late-stage evolved ABEs mediate genomic DNA editing with greater activity and broader sequence compatibility.

A sixth round of evolution aimed to remove any non-beneficial mutations by DNA shuffling and to reexamine mutations from previous rounds of evolution that may have different effects on ABE performance once liberated from negative epistasis with other mutations. Evolved TadA*-dCas9 variants from rounds 1 through 5 along with wild-type E. coli TadA were shuffled, transformed into E. coli harboring the spectinomycin resistance T89I selection plasmid, and selected on media supplemented with 384 µg/mL spectinomycin. Two mutations were strongly enriched from this selection: P48S/T and A142N (first seen from round 4). These mutations were added either separately or together to ABE5.3, forming ABE6.1 to ABE6.6 (FIG. 7). ABE6.3 (ABE5.3+P48S) resulted in 1.3±0.28-fold higher average A•T to G•C editing relative to ABE5.3 at each of the six genomic sites tested, and an average conversion efficiency of 47±5.8% (FIGS. 2B and 4A). P48 is predicted to lie ~5 A from the substrate adenine nucleobase and 2'-hydroxyl in the TadA crystal structure (FIG. 2C), and it was speculated that mutating this residue to Ser may improve compatibility with a deoxyadenosine substrate. While at most sites ABE6 variants that contained the A142N mutation were less active than ABEs that lack this mutation, editing by ABE6.4 (ABE6.3+A142N) at site 6, which contains a target A at position 7 in the protospacer, was 1.5±0.13-fold more efficient than editing by ABE6.3, and 1.8±0.16-fold more efficient than editing by ABE5.3 (FIG. 4A). These results suggest that A142N variants may offer improved editing of target adenines closer to the PAM than position 5.

Although six rounds of evolution and engineering yielded substantial improvements, ABE6 editors still suffered from reduced editing efficiencies (~20-40%) at target sequences containing multiple adenines near the targeted A, such as site 3 (AAG) and site 4 (CAA) (FIG. 4A). To address this challenge, a seventh round of evolution was performed in which freshly generated libraries of TadA*6-dCas9 variants were targeted to two separate sites in the kanamycin resistance gene: the Q4stop mutation used in round 3 that requires editing a TAT motif, and a new D208N mutation that requires editing a TAA sequence (FIGS. 22 and 23, Supplementary Sequences 2). The MIC of host cells harboring the round 7 selection plasmid was 8 µg/mL kanamycin (FIG. 23). Unbiased libraries of mutated TadA*6-dCas9 variants were transformed into E. coli, and selected on media containing 64 µg/mL to 384 µg/mL kanamycin. Surviving clones contained three enriched sets of mutations: W23L/R, P48A, and R152H/P.

Introducing these mutations separately or in combinations into mammalian cell ABEs (ABE7.1 to ABE7.10), resulted in substantial increases in A•T to G•C editing efficiencies, especially at targets that contain multiple A residues (FIGS. 2B, 4A, 4B, 7, 12A, and 12B). ABE7.10 edited the six genomic test sites with an average efficiency 58±4.0%, and an average improvement at each site of 1.3±0.20-fold relative to ABE6.3 (FIG. 4A), and 29±7.4-fold compared to ABE1.2. Although mutational dissection revealed that all three of the new mutations contribute to the increase in editing efficiencies (FIGS. 7, 12A, and 12B), the R152P substitution is particularly noteworthy. The aligned ecTadA crystal structure predicts that R152 is in the C-terminal helix and contacts the C in the UAC anticodon loop of the tRNA substrate (FIGS. 2B and 2C). It is speculated that substitution of Arg for Pro disrupts this helix and may abrogate base-specific enzyme:DNA interactions.

Example 5—Characterization of Late-Stage ABEs

Figure 4B:
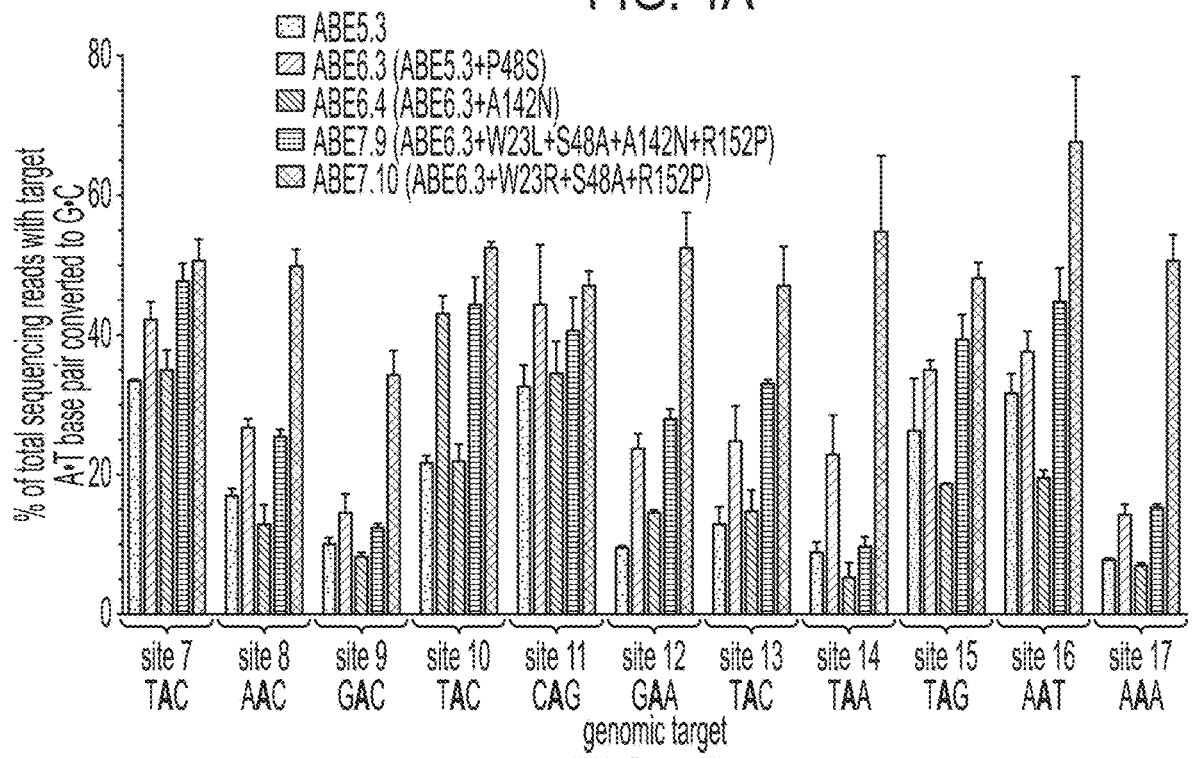

The most promising ABEs from rounds 5-7 were characterized in-depth. An expanded set of 17 human genomic targets was chosen that place a target A at position 5 or 7 of the protospacer and collectively include all possible NAN sequence contexts (FIG. 3A). Overall, strong improvement of A•T to G•C editing efficiency was observed in HEK293T cells during the progression from ABES to ABET variants (FIG. 4B). The base editing efficiency of the most active editor overall, ABE7.10, averaged 53±3.7% at the 17 sites tested, exceeded 50% at 11 of these sites, and ranged from 34-68% (FIGS. 4A and 4B). These efficiencies compare favorably to the typical C•G to T•A editing efficiencies of BE3[6].

Figure 5A:
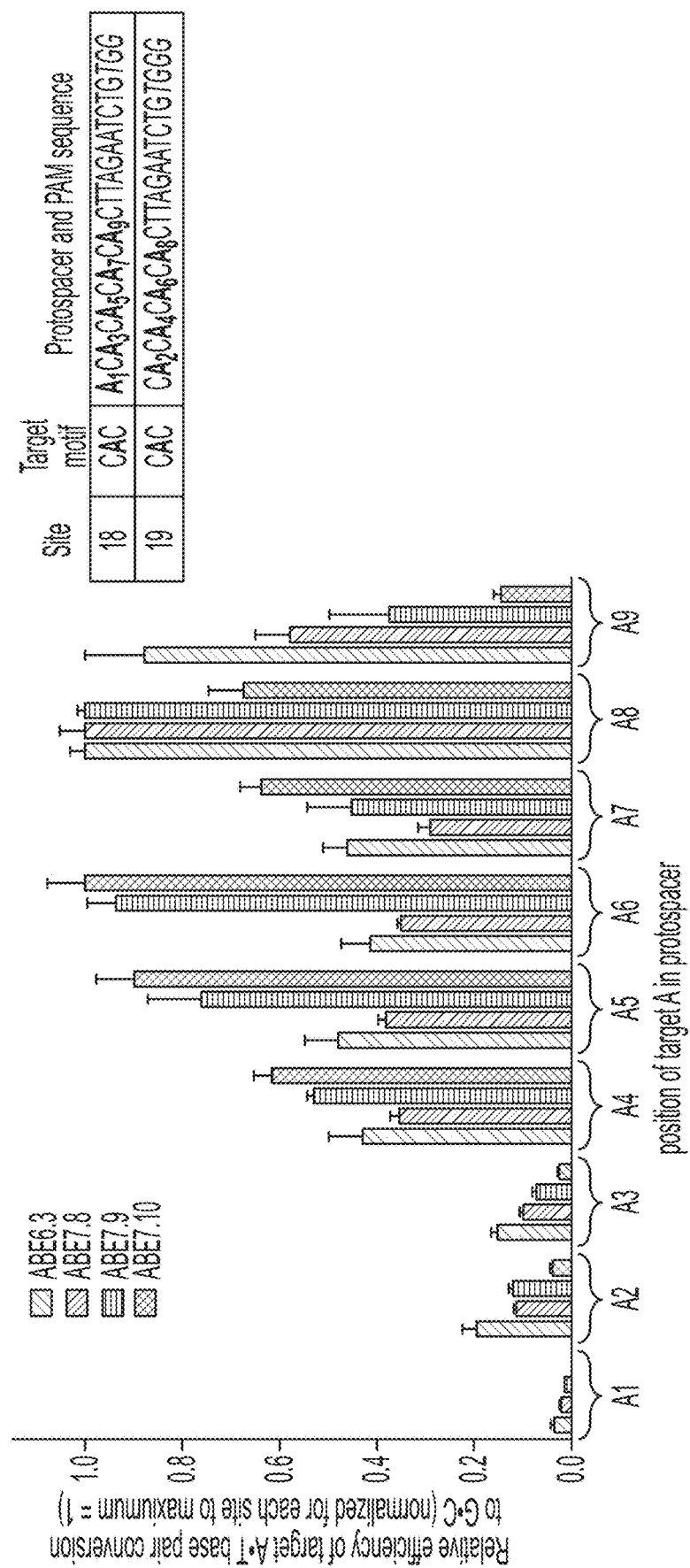
Figure 5B:
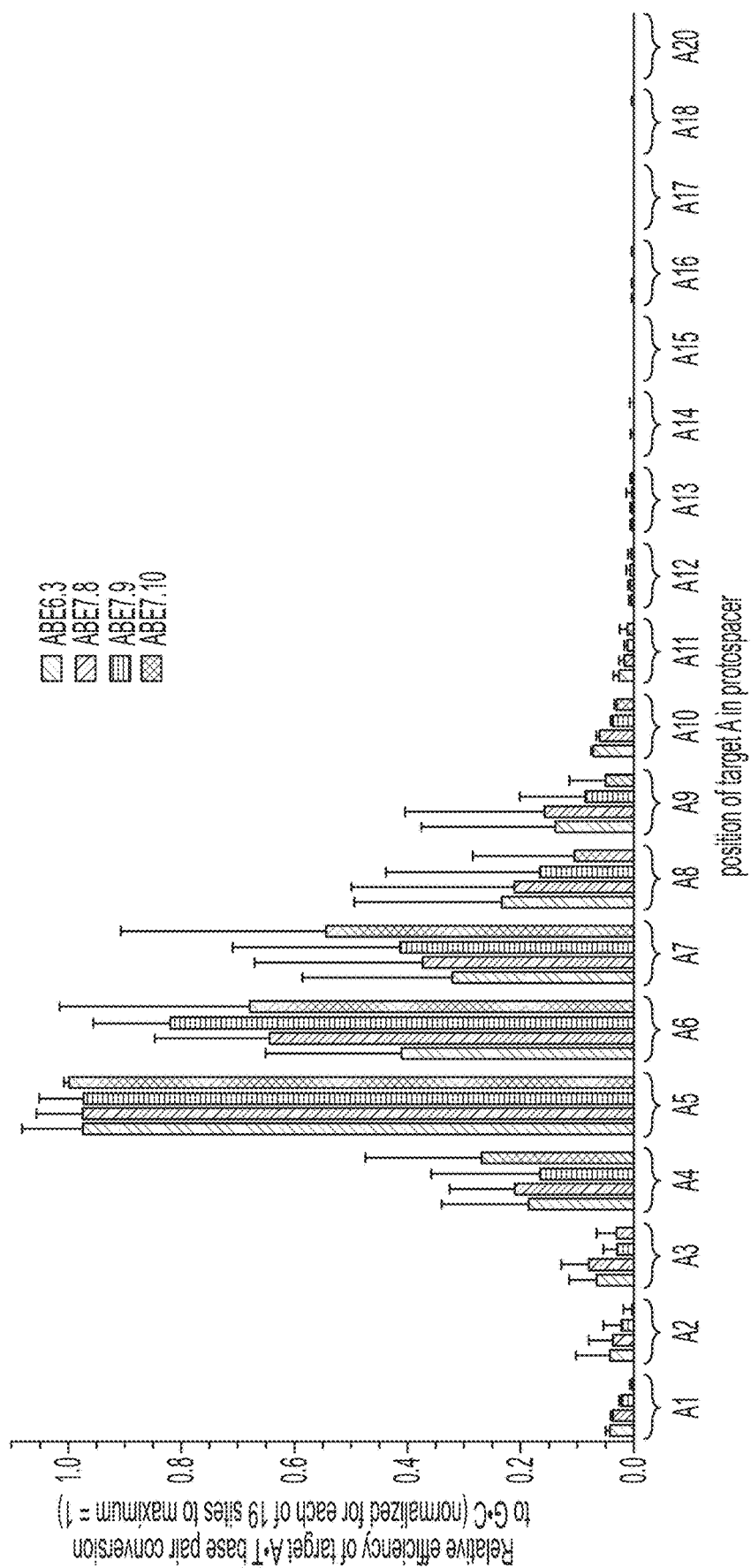
Figure 12A:
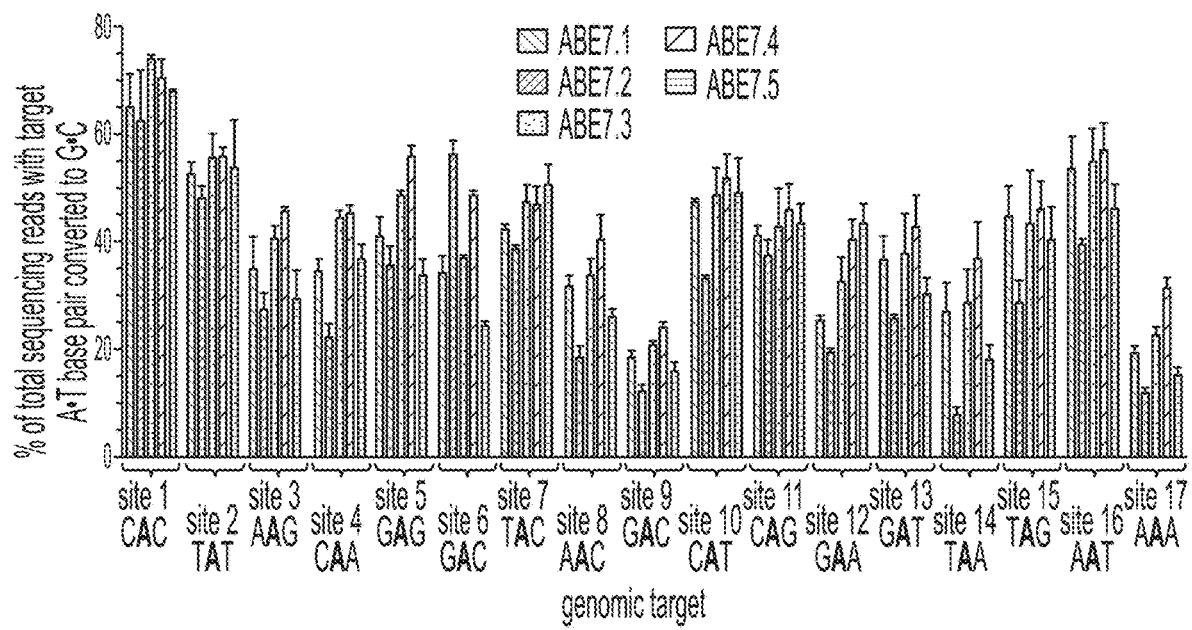
FIGS. 12A to 12C show base editing efficiencies of ABE7 variants at 17 genomic sites. A•T to G•C base editing efficiencies in HEK293T cells at 17 human genomic target DNA sites of ABE7.1-7.5 (FIG. 12A), and ABE7.6-7.10 (FIG. 12B). See FIG. 7 for ABE genotypes and architectures.
Figure 12B:
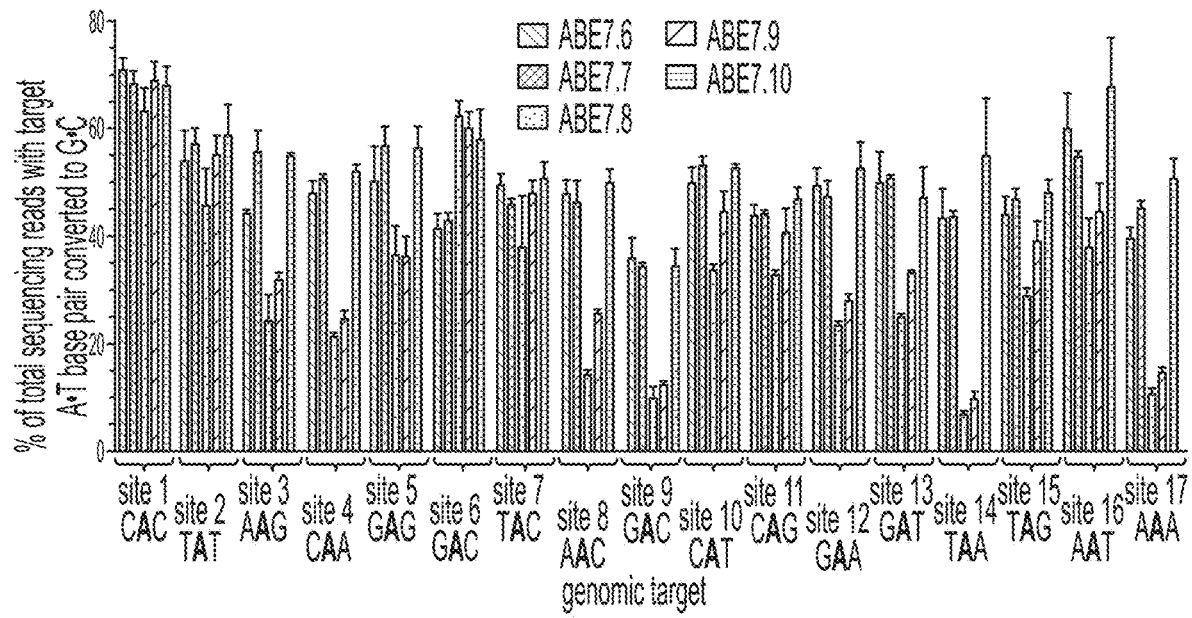
Figure 12C:
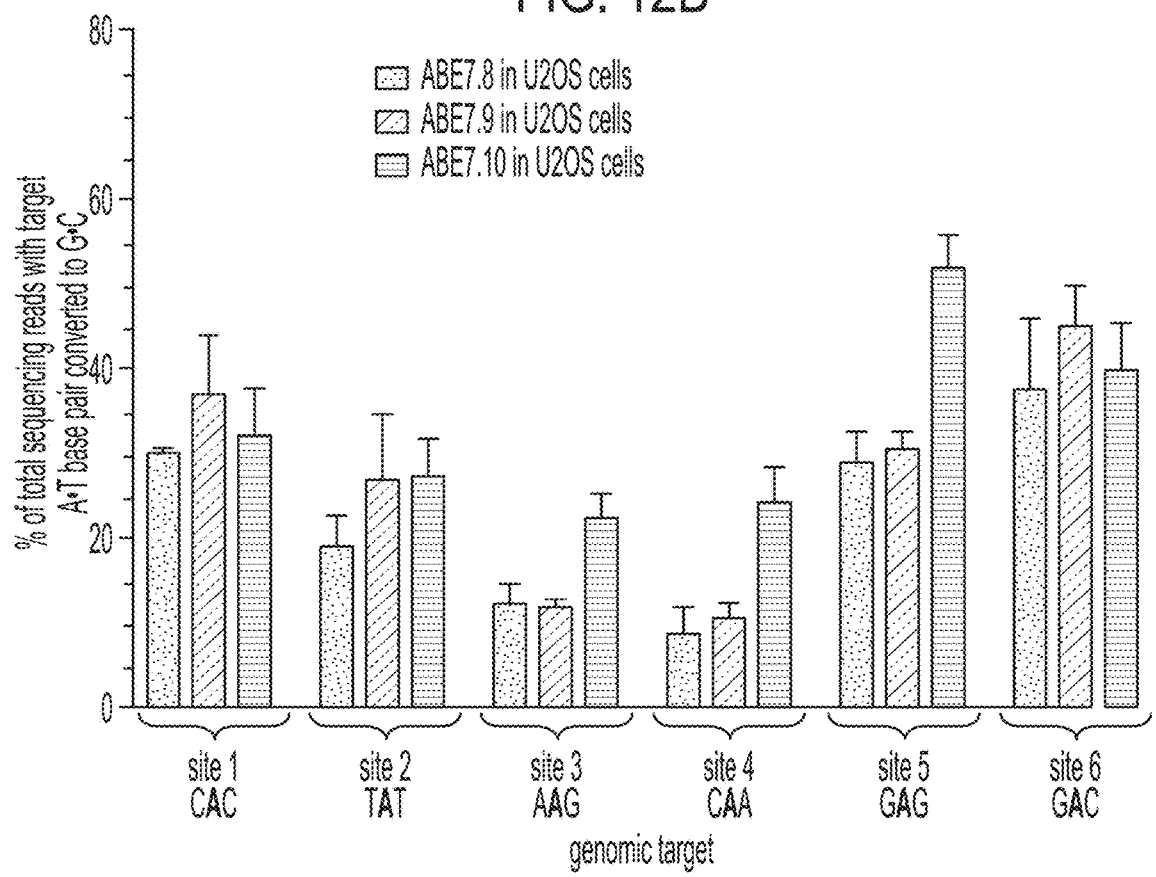
Figure 13:
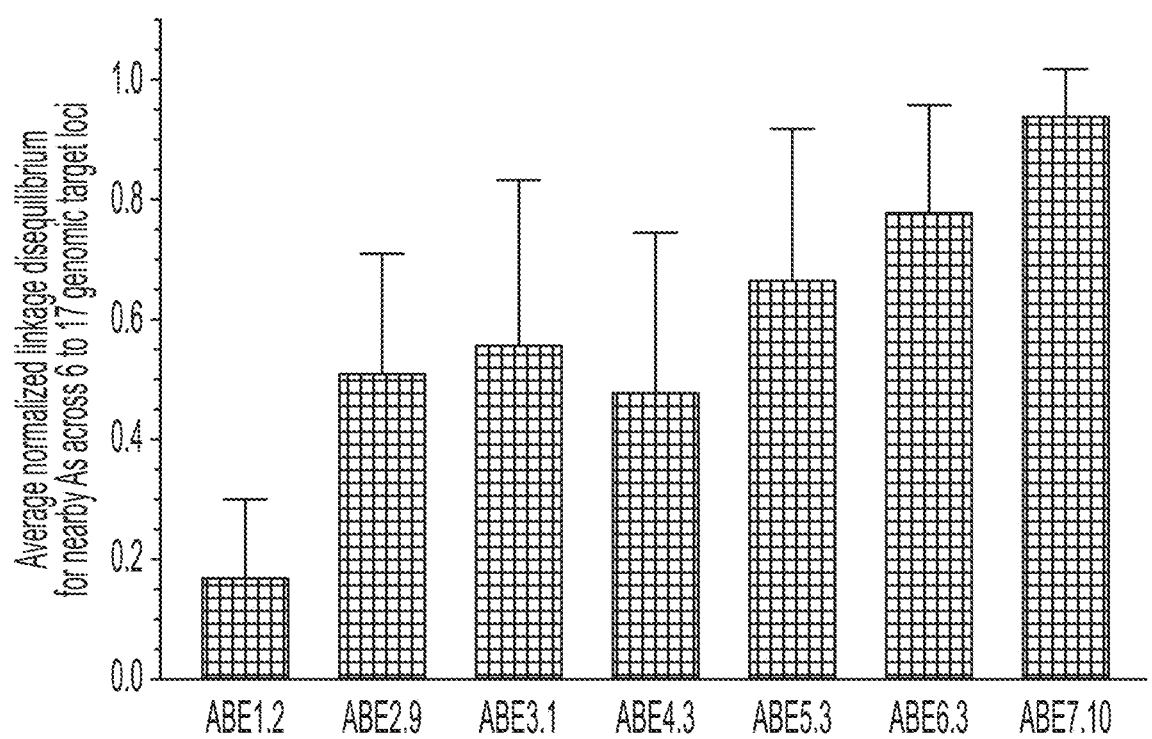
FIG. 13 shows rounds of evolution and engineering increased ABE processivity. The calculated mean normalized linkage disequilibrium (LD) between nearby target As at 6 to 17 human genomic target DNA sites for the most active ABEs emerging from each round of evolution and engineering. Higher LD values indicate that an ABE is more likely to edit an A if a nearby A in the same DNA strand (the same sequencing read) is also edited. LD values are normalized from 0 to 1 in order to be independent of editing efficiency. Values and error bars reflect the mean and s.d. of normalized LD values from three independent biological replicates performed on different days.

Next it was sought to further characterize the base editing activity window of late-stage ABEs. A human genomic site containing an alternating 5'-A-N-A-N-A-N-3' sequence that could be targeted with either of two sgRNAs such that an A would be located either at every odd position (site 18) or at every even position (site 19) from 2 to 9 in the protospacer was chosen (FIG. 3A). The resulting editing outcomes (FIG. 5A), together with an analysis of editing efficiencies at every protospacer position across all 19 sites tested (FIG. 5B) suggest that the activity windows of late-stage variants are approximately 4-6 nucleotides wide, from protospacer positions ~4-7 for ABE7.10, and from positions ~4-9 for ABE6.3, ABE7.8, and ABE7.9, counting the PAM as positions 21-23 (FIGS. 5A to 5C). It is noted that the precise editing window boundaries can vary in a target-dependent manner (FIG. 16), as is the case with BE3 and BE4. ABE7.8, ABE7.9, and ABE7.10 were also tested in U2OS cells at sites 1-6 and similar editing results were observed as in HEK293T cells (FIG. 12C), demonstrating that ABE activity is not limited to HEK293T cells.

Figure 14A:
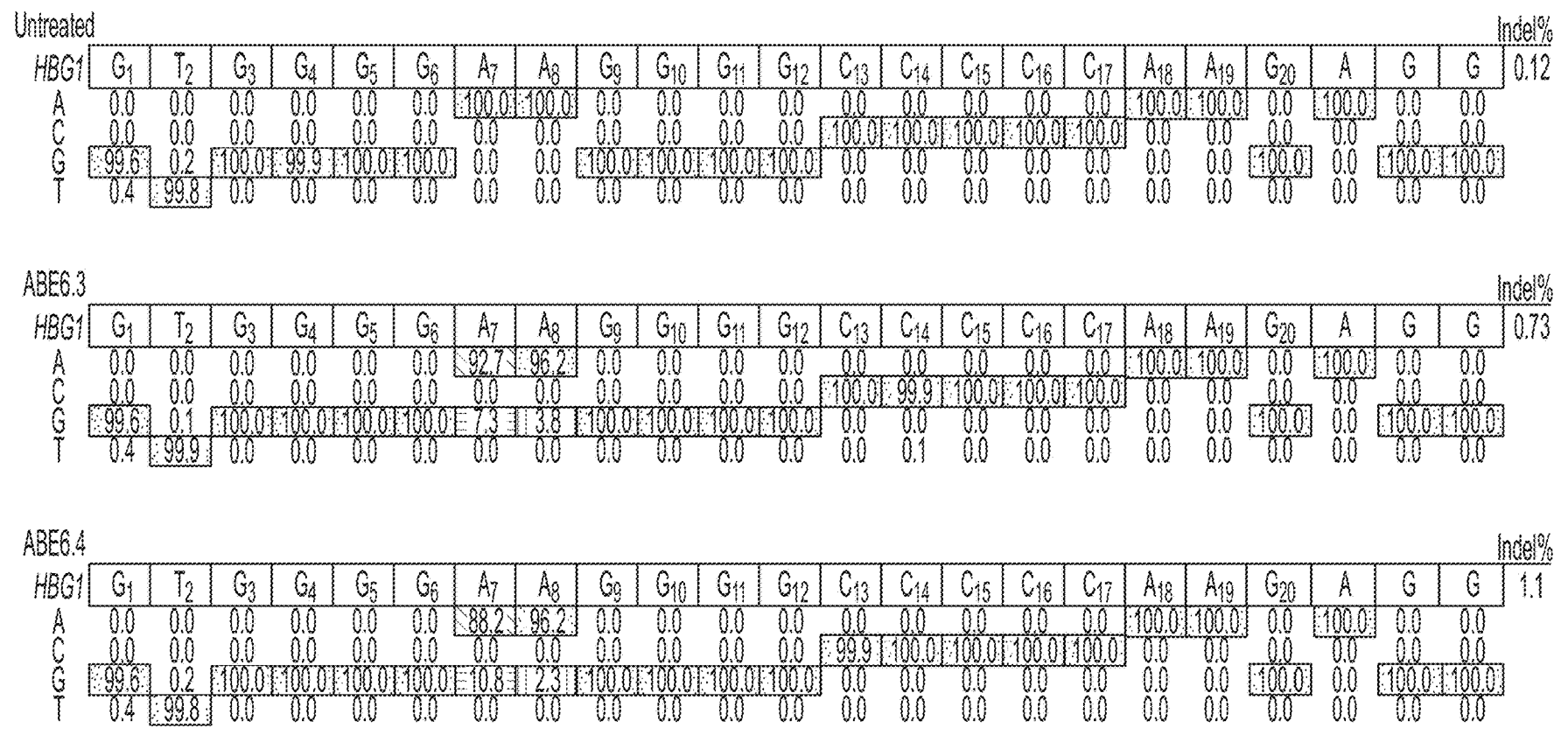
Figure 14B:
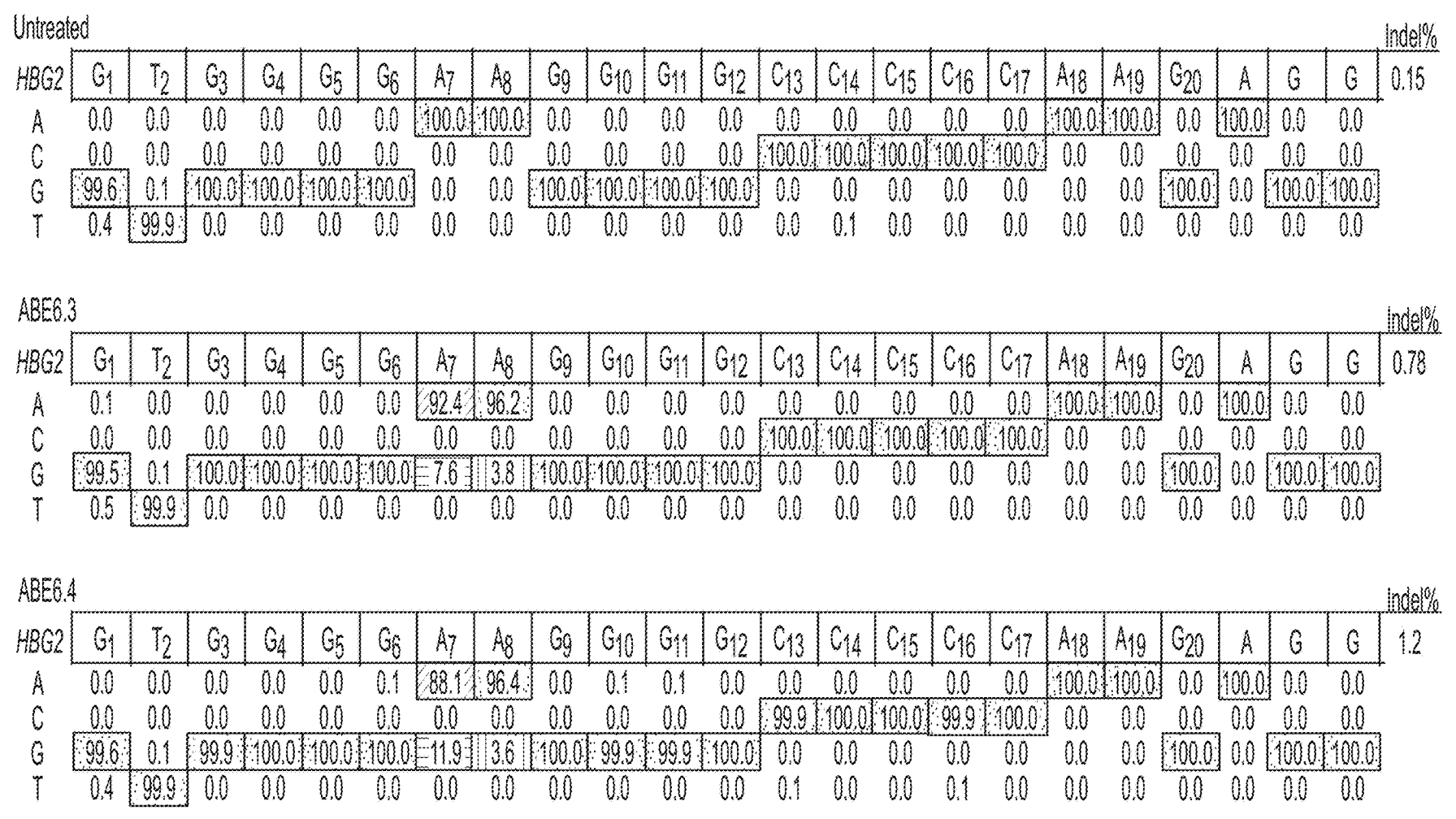

Analysis of individual high-throughput DNA sequencing reads from ABE editing at 6 to 17 genomic sites in HEK293T cells reveals that base editing outcomes at nearby adenines within the editing window are not statistically independent events. The average normalized linkage disequilibrium (LD) between nearby target adenines steadily increased as ABE evolution proceeded, such that the normalized LD of ABE1.2, ABE3.1, ABE5.3, and ABE7.10 averaged 0.17±0.12, 0.56±0.27, 0.67±0.25, and 0.94±0.08, respectively (FIGS. 14A and 14B). Therefore, early-stage ABEs edit nearby adenines more independently, while late-stage ABEs edit nearby adenines more processively, and are more likely to edit an A if a nearby A in the same DNA strand is also edited. These findings suggest that during the course of evolution, TadA may have evolved kinetic changes that decrease the likelihood of substrate release before additional As within the editing window are converted, resulting in processivity similar to the behavior of BE3[6].

Figure 16:
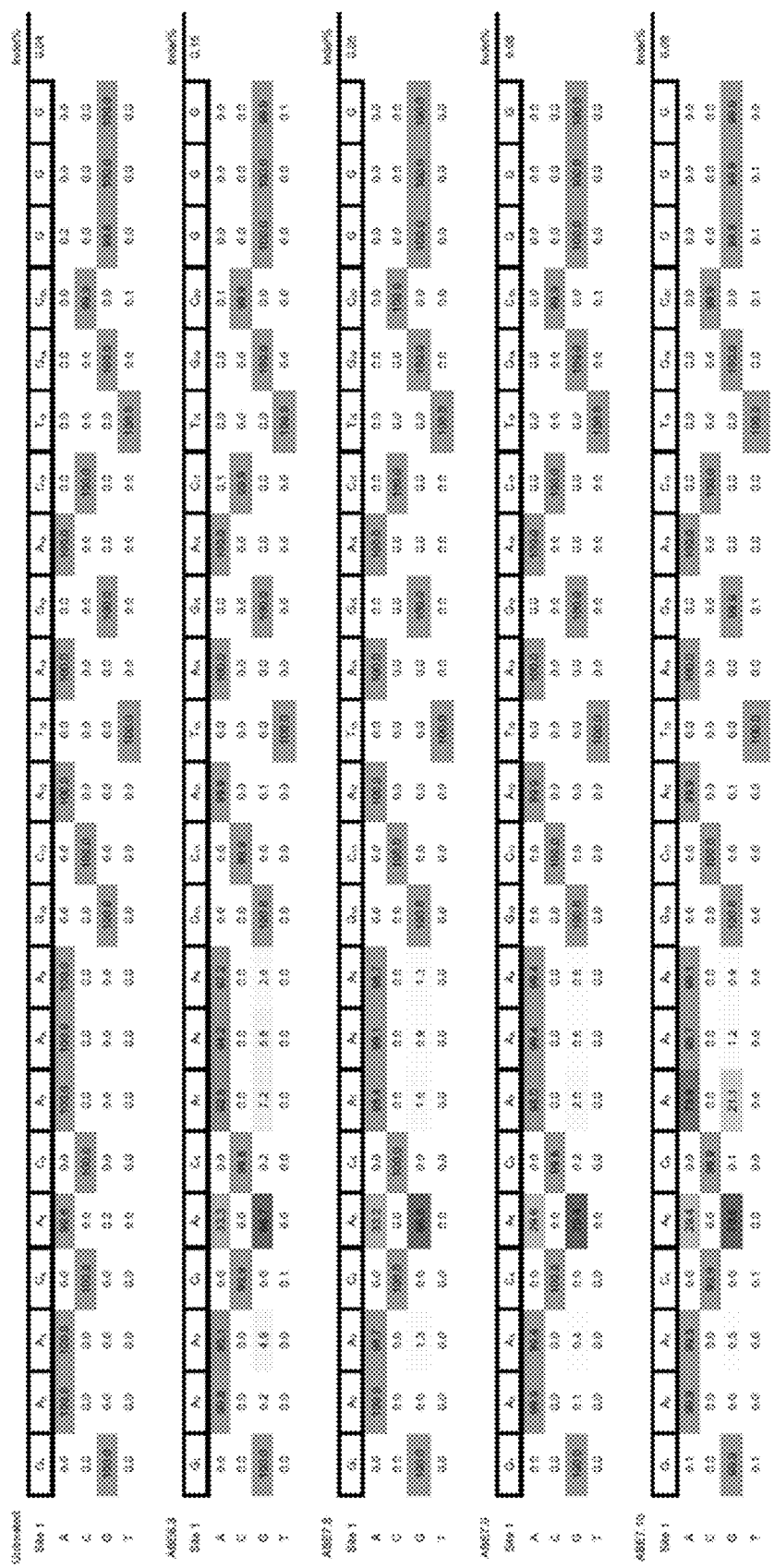
FIG. 16 shows HTS sequencing results and % indel of untreated HEK293T cells and HEK293T cells treated with ABE6.3, ABE7.8, ABE7.9, or ABE7.10 at 17 genomic sites with co-transfection of a corresponding sgRNA expression plasmid. One arbitrarily chosen replicate is shown; the data for all replicates is available from the NCBI sequencing read archive.
Figure 16:
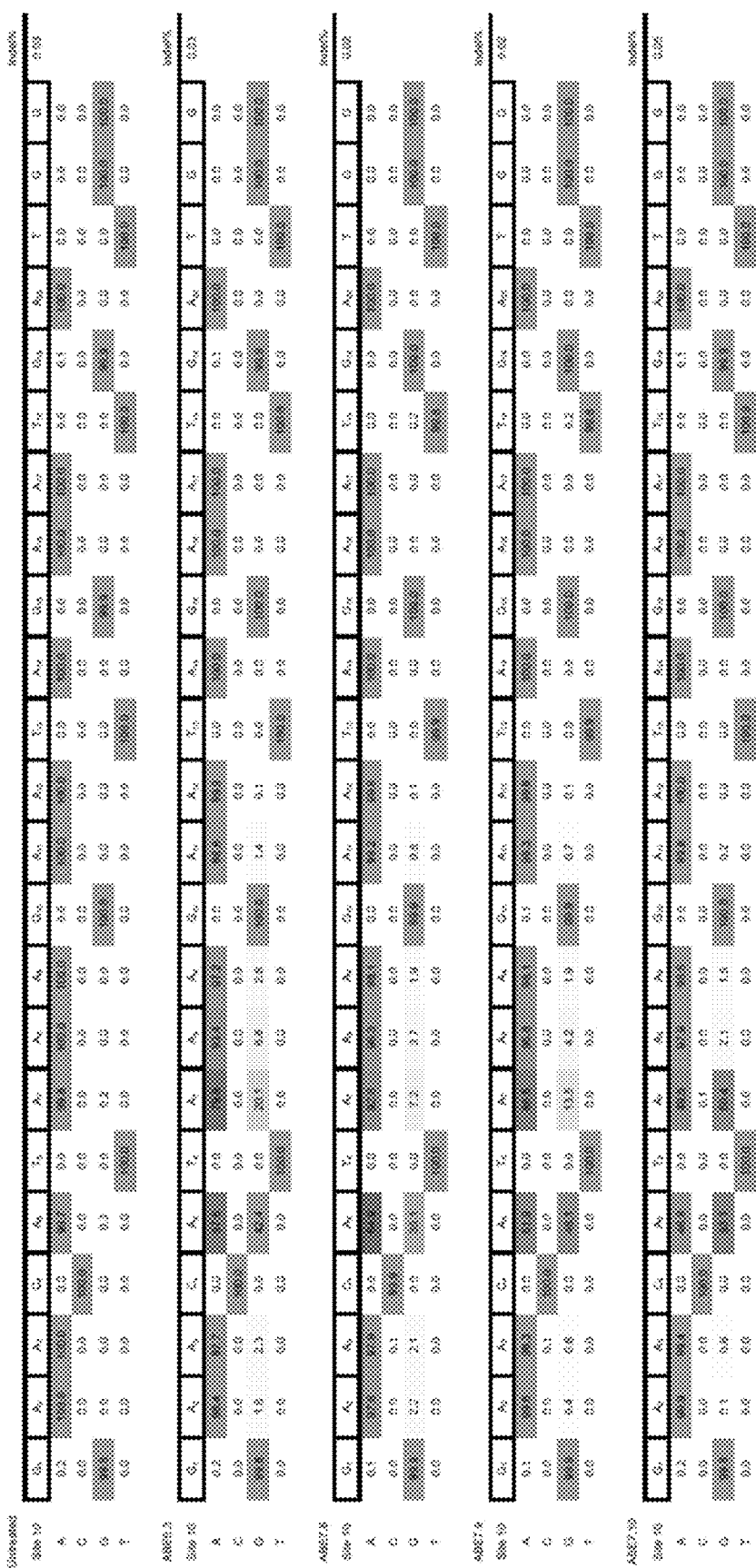
Figure 16:
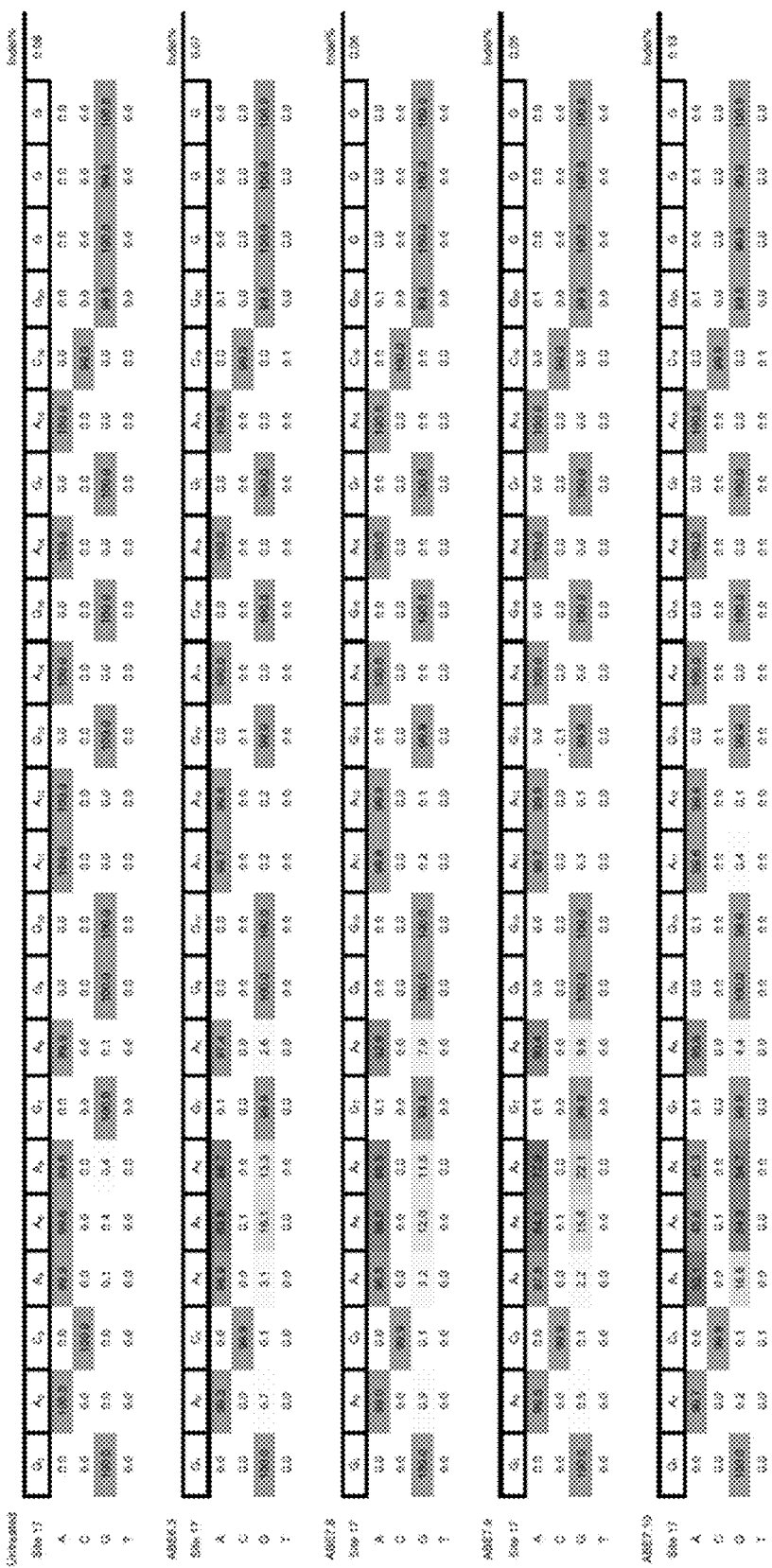

In contrast to the formation of C to non-T edits and indels that can arise from BE3-mediated base editing of cytidines, ABEs convert A•T to G•C very cleanly in HEK293T and U2OS cells, with an average of <0.1% indels, similar to that of untreated control cells, and no observed A to non-G editing above that of untreated cells among the 17 genomic NAN sites tested (FIGS. 5C and 16). It was recently shown that undesired products of BE3 arise from uracil excision and downstream repair processes[9]. The remarkable product purity of all tested ABE variants compared to BE3 suggests that the activity or abundance of enzymes that remove inosine from DNA may be low compared to the those of UNG, resulting in minimal base excision repair following adenine base editing.

Figure 6A:
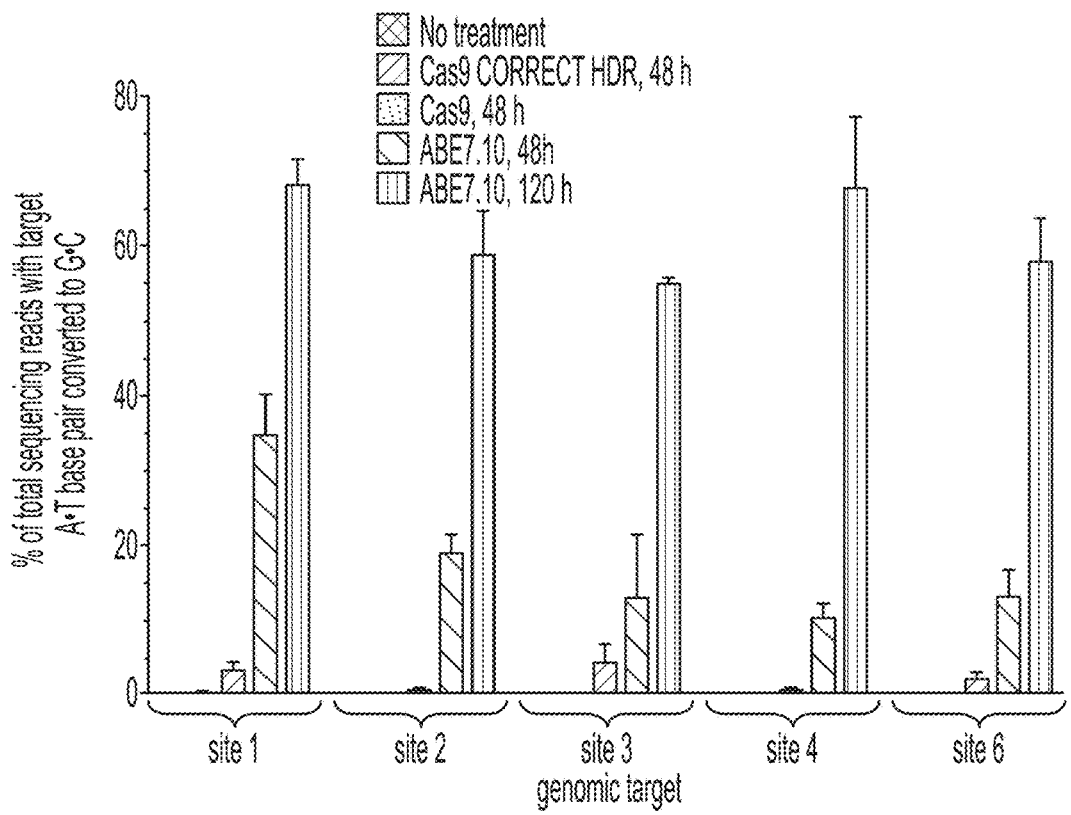
Figure 6B:
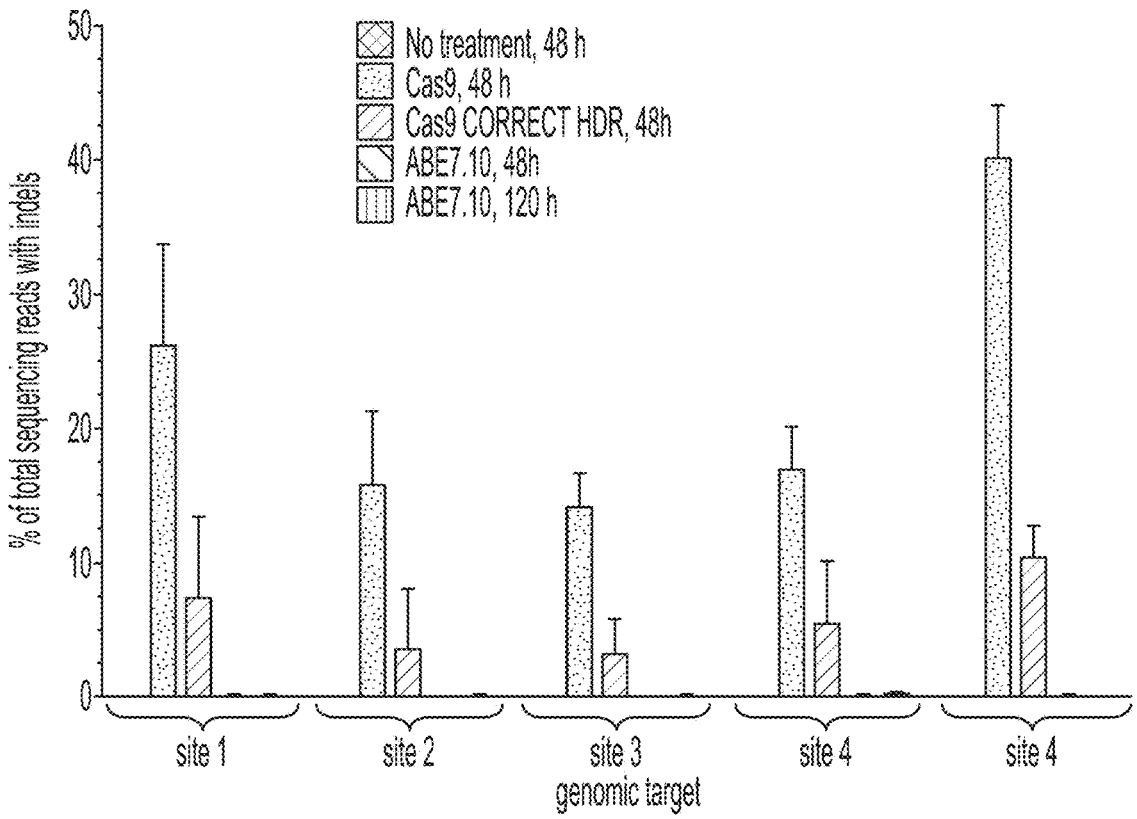

ABE7.10 catalyzed A•T to G•C editing efficiencies were compared to those of a state-of-the-art Cas9 nuclease-mediated HDR method, CORRECT[41]. At five genomic loci in HEK293T cells average target mutation frequencies ranging from 0.47% to 4.2% with 3.3% to 10.6% indels were observed using the CORRECT HDR method under optimized 48-h conditions in HEK293T cells (FIG. 6A). At these same five genomic loci, ABE7.10 resulted in average target mutation frequencies of 10-35% after 48 h, and 55-68% after 120 h (FIG. 6A), with <0.1% indels (FIG. 6B). The target mutation:indel ratio averaged 0.43 for CORRECT HDR, and >500 for ABE7.10, representing a >1,000-fold improvement in product selectivity favoring ABE7.10. These results demonstrate that ABE7.10 can introduce A•T to G•C point mutations with much higher efficiency and far fewer undesired products than a current Cas9 nuclease-mediated HDR method.

Figure 19:
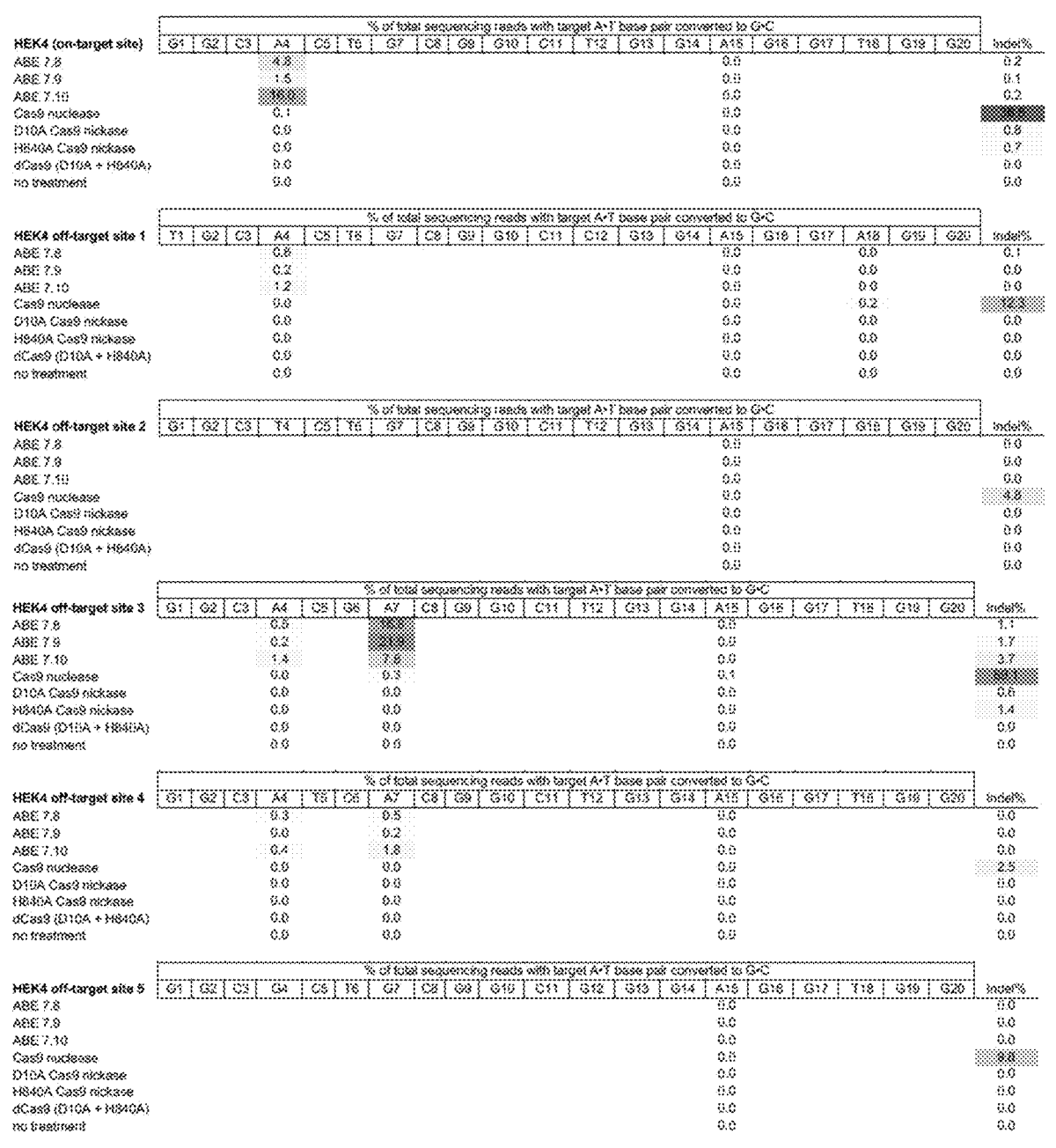

Next the off-target activity of ABE7 variants was examined. Since no method yet exists to comprehensively profile off-target activity of ABEs, it was assumed that off-target ABE editing primarily occurs at the same off-target sites that are edited when Cas9 nuclease is complexed with a particular guide RNA, as has been observed to be the case with BE3[6,8,9,42]. HEK293T cells were treated with three well-characterized guide RNAs (targeting HEK sites 2, 3, and 4)[43] and either Cas9 nuclease or ABE7 variants and sequenced the on-target loci and the 12 most active off-target human genomic loci associated with these guide RNAs as identified by the genome-wide GUIDE-Seq method.[43] The efficiency of on-target indels by Cas9 and the efficiency of on-target base editing by ABE7.10 both averaged 54% (FIGS. 17-19). Detectable modification (≥0.2% indels) by Cas9 nuclease was observed at nine of the 12 (75%) known off-target loci (FIG. 6C and FIGS. 17-19). In contrast, when complexed with the same sgRNAs, ABE7.10, ABE7.9, or ABE 7.8 led to ≥0.2% off-target base editing at only four of the 12 (33%) known Cas9 off-target sites. Moreover, the nine confirmed Cas9 off-target loci were modified with an average efficiency of 14% indels, while the four confirmed ABE off-target loci were modified with an average of only 1.3% A•T to G•C mutation (FIGS. 17-19). Although seven of the nine confirmed Cas9 off-target loci contained at least one A within the ABE activity window, three of these seven off-target loci were not detectably edited by ABE7.8, 7.9, or 7.10. Together, these data suggest that ABE7 variants may be less prone to off-target genome modification than Cas9 nuclease, even for off-target sites containing editable As. In addition, there was no detected evidence of ABE-induced A•T to G•C editing outside of on-target or off-target protospacers following ABE treatment.

Example 6—ABE-Mediated Correction and Installation of Mutations Relevant to Human Disease Finally, the potential of ABEs to correct pathogenic mutations and to introduce disease-suppressing mutations in mammalian cells was tested. Mutations in b-globin genes cause a variety of blood diseases. Humans with the rare benign condition HPFH (hereditary persistence of fetal hemoglobin) are resistant to some b-globin diseases including sickle-cell anemia. In certain patients, this phenotype is mediated by mutations in the promoters of the g-globin genes HBG1 and HBG2 that enable sustained expression of fetal hemoglobin, which is normally silenced in humans around birth[44,45]. An sgRNA was designed that programs ABE to simultaneously mutate −198T to C in the promoter driving HBG1 expression, and −198T to C in the promoter driving HBG2 expression, by placing the target A•T base pair at protospacer position 7. These mutations are known to confer British-type HPFH and enable fetal hemoglobin production in adults[46]. ABE7.10 installed the desired T•A to C•G mutations in the HBG1 and HBG2 promoters with 29% and 30% efficiency, respectively, in HEK293T cells (FIGS. 6C and 14).

The iron storage disorder hereditary hemochromatosis (HHC) is an autosomal recessive genetic disorder commonly caused by a G to A mutation at nucleotide 845 in the human HFE gene, resulting in a C282Y mutation in the HFE protein[47,48]. This mutation leads to insufficient production of liver iron hormone hepcidin resulting in excessive intestinal iron absorption and potentially life-threatening elevation of serum ferritin. DNA encoding ABE7.10 and a guide RNA that places the target A at protospacer position 5 was transfected into an immortalized lymphoblastoid cell line (LCL) harboring the HFE C282Y genomic mutation. Due to the extreme resistance of LCL cells to transfection, transfected cells were isolated and editing efficiency was measured by HTS of the resulting genomic DNA. The clean conversion of the Tyr282 to Cys282 codon was observed in 28% of total DNA sequencing reads from transfected cells, with no evidence of undesired editing or indels at the on-target locus (FIG. 6C). Although much additional research is needed to develop these ABE editing strategies into potential future clinical therapies for globinopathies, HHC, and other diseases with a genetic component, these examples collectively demonstrate the potential of ABEs to correct disease-driving mutations, and to install mutations known to suppress genetic disease phenotypes, in human cells.

In summary, seven rounds of evolution and engineering transformed a protein that initially exhibited no ability to deaminate adenine at target loci in DNA (wild-type TadA-dCas9 fusions) into forms that edit DNA weakly (ABE1s and ABE2s), variants that edit limited subsets of sites efficiently (ABE3s, ABE4s, and ABE5s), and, ultimately, highly active adenine base editors with broad sequence compatibility (ABE6s and ABE7s). The development of ABEs greatly expands the capabilities of base editing and the fraction of pathogenic SNPs that can be addressed by genome editing without introducing double-stranded DNA breaks (FIG. 1A). In addition, ABEs can also be used to make precise genetic changes of broad utility, including 63 non-synonymous codon changes, the destruction or creation of start codons, the destruction of premature stop codons, the repair of splicing donor or acceptor sites, and the modification of regulatory sequences. ABE7.10 is recommended for general A•T to G•C base editing. When the target A is at protospacer positions 8-10, ABE7.9, ABE7.8, or ABE6.3 may offer higher editing efficiencies than ABE7.10, although conversion efficiencies at these positions are typically lower than at protospacer positions 4-7. Together with BE3 and BE4[9], these ABEs advance the field of genome editing by enabling the direct installation of all four transition mutations at target loci in living cells with a minimum of undesired byproducts.

Data Availability.

Expression vectors encoding ABE6.3, ABE7.8, ABE7.9, and ABE7.10 are available from Addgene. High-throughput DNA sequencing data will be deposited in the NCBI Sequence Read Archive.

Methods

General Methods.

DNA amplification was conducted by PCR using Phusion U Green Multiplex PCR Master Mix (ThermoFisher Scientific) or Q5 Hot Start High-Fidelity 2x Master Mix (New England BioLabs) unless otherwise noted. All mammalian cell and bacterial plasmids generated in this work were assembled using the USER cloning method as previously described[49] and starting material gene templates were synthetically accessed as either bacterial or mammalian codon-optimized gBlock Gene Fragments (Integrated DNA Technologies). All sgRNA expression plasmids were constructed by a 1-piece blunt-end ligation of a PCR product containing a variable 20-nt sequence corresponding to the desired sgRNA targeted site. Primers and templates used in the synthesis of all sgRNA plasmids used in this work are listed in FIG. 20. All mammalian ABE constructs sgRNA plasmids and bacterial constructs were transformed and stored as glycerol stocks at −80° C. in Mach1 T1$^R$ Competent Cells (Thermo Fisher Scientific), which are recA⁻. Molecular Biology grade, Hyclone water (GE Healthcare Life Sciences) was used in all assays and PCR reactions. All vectors used in evolution experiments and mammalian cell assays were purified using ZympPURE Plasmid Midiprep (Zymo Research Corporation), which includes endotoxin removal. Antibiotics used for either plasmid maintenance or selection during evolution were purchased from Gold Biotechnology.

Generation of Bacterial TadA* Libraries (Evolution Rounds 1-3, 5, and 7).

Briefly, libraries of bacterial ABE constructs were generated by two-piece USER assembly of a PCR product containing a mutagenized E. coli TadA gene and a PCR product containing the remaining portion of the editor plasmid (including the XTEN linker, dCas9, sgRNA, selectable marker, origin of replication, and promoter). Specifically, mutations were introduced into the starting template (FIG. 22) in 8×25 μL PCR reactions containing 75 ng-1.2 μg of template using Mutazyme II (Agilent Technologies) following the manufacturer's protocol and primers NMG-823 and 824 (FIG. 21). After amplification, the resulting PCR products were pooled and purified from polymerase and reaction buffer using a MinElute PCR Purification Kit (Qiagen). The PCR product was treated with Dpn1 (NEB) at 37° C. for 2 h to digest any residual template plasmid. The desired PCR product was subsequently purified by gel electrophoresis using a 1% agarose gel containing 0.5 μg/mL ethidium bromide. The PCR product was extracted from the gel using the QIAquick Gel Extraction Kit (Qiagen) and eluted with 30 μL of H$_2$O. Following gel purification, the mutagenized ecTadA DNA fragment was amplified with primers NMG-825 and NMG-826 (FIG. 21) using Phusion U Green Multiplex PCR Master Mix (8×50 μL PCR reactions, 66° C. annealing, 20-s extension) in order to install the appropriate USER junction sequences onto the 5' and 3' end of the fragment. The resulting PCR product was purified by gel electrophoresis. Next, the backbone of the bacterial base editor plasmid template (FIG. 22), was amplified with primers NMG-799 and NMG-824 (FIG. 21) and Phusion U Green Multiplex PCR Master Mix (100 μL per well in a 98-well PCR plate, 5-6 plates total, Tm 66° C., 4.5-min extension) following the manufacturer's protocol. Each PCR reaction was combined with 300 mL of PB DNA binding buffer (Qiagen) and 25 mL of the solution was loaded onto a HiBind DNA Midi column (Omega Bio-Tek). Bound DNA was washed with 5 column volumes of PE wash buffer (Qiagen) and the DNA fragment was eluted with 800 μL of H$_2$O per column. Both DNA fragments were quantified using a NanoDrop 1000 Spectrophotometer (Themo Fisher Scientific).

TadA* libraries were assembled following a previously reported USER assembly procedure with the following conditions: 0.22 pmol of ecTadA mutagenized DNA fragment 1, 0.22 pmol of plasmid backbone fragment 2, 1 U of USER (Uracil-Specific Excision Reagent, New England Biolabs) enzyme, and 1 U of Dpn1 enzyme (New England Biolabs) per 10 μL of USER assembly mixture were combined in 50 mM potassium acetate, 20 Mm Tris-acetate, 10 mM magnesium acetate, 100m/mL BSA at pH7.9 (1× CutSmart Buffer, New England Biolabs). Generally, each round of evolution required ~1 mL of USER assembly mixture (22 nmol of each DNA assembly fragment) which was distributed into 10-μL aliquots across multiple 8-well PCR strips. The reactions were warmed to 37° C. for 60 min, then heated to 80° C. for 3 min to denature the two enzymes. The assembly mixture was slowly cooled to 12° C. at 0.1° C./s in a thermocycler to promote annealing of the freshly generated ends of the two USER junctions.

With a library of constructs in hand, denatured enzymes and reaction buffer were removed from the assembly mixture by adding 5 vol of PB buffer (Qiagen) to the assembly reaction mixture and binding the material onto a MinElute column (480 μL per column). ABE hybridized library constructs were eluted in 30 μL of H$_2$O per column and 2 μL of this eluted material was added to 20 μL of NEB 10-beta electrocompetent E. coli and electroporated with a Lonza 4D-Nucleofector System using bacterial program 5 in a 16-well Nucleocuvette strip. A typical round of evolution used ~300 electroporations to generate 5-10 million colony forming units (cfu). Freshly electroporated E. coli were recovered in 200 mL pre-warmed Davis Rich Media (DRM) at 37° C., and incubated with shaking at 200 rpm in a 500-mL vented baffled flask for 15 min before carbenicillin (for plasmid maintenance) was added to 30m/mL. The culture was incubated at 37° C. with shaking at 200 rpm for 18 h. The plasmid library was isolated with a ZympPURE Plasmid Midiprep kit following manufacturer's procedure (50 mL culture per DNA column), except the plasmid library was eluted in 200 μL pre-warmed water per column. Evolution rounds 1-3, 5 and 7 followed this procedure in order to generate the corresponding library with minor variations (FIG. 22).

Generation of Site-Saturated Bacterial TadA* Library (Evolution Round 4).

Mutagenesis at Arg24, Glu25, Arg107, Ala142, and Ala143 of ecTadA was achieved using ecTadA*(2.1)-dCas9 as a template and amplifying with appropriately designed degenerate NNK-containing primers (FIG. 21). Briefly, ecTadA*(2.1)-dCas9 template was amplified separately with two sets of primers: NMG-1197+NMG-1200, and NMG-1199+NMG-1200, using Phusion U Green Multiplex PCR Master Mix, forming PCR product 1 and PCR product 2 respectively. Both PCR products were purified individually using PB binding buffer and a MiniElute column and eluted with 20 μL of H$_2$O per 200 μL of PCR reaction. In a third PCR reaction, 1 μL of PCR product 1 and 1 μL PCR product 2 were combined with exterior, uracil-containing primers NMG-1202 and NMG-1197, and amplified by Phusion U Green Multiplex PCR Master Mix to form the desired extension-overlap PCR product with flanking uracil-containing USER junctions. In a fourth PCR reaction, ecTadA* (2.1)-dCas9 was amplified with NMG-1201 and NMG-1198 to generate the backbone DNA fragment for USER assembly. After Dpn1 digestion and gel purification of both USER assembly fragments, the extension-overlap PCR product (containing the desired NNK mutations in ecTadA) was incorporated into the ecTadA*(2.1)-dCas9 backbone by USER assembly as described above. The freshly generated NNK library was transformed into NEB 10-beta electrocompotent E. coli and the DNA was harvested as described above.

Generation of DNA-Shuffled Bacterial TadA* Library (Evolution Round 6).

DNA shuffling was achieved by a modified version of the nucleotide exchange and excision technology (NExT) DNA shuffling method[50]. Solutions of 10 mM each of dATP, dCTP, dGTP and dTTP/dUTP (3 parts dUTP: 7 parts dTTP) were freshly prepared. Next, the TadA* fragment was amplified from 20 fmol of a pool of TadA*-XTEN-dCas9 bacterial constructs isolated from evolution rounds 1-5 in equimolar concentrations using Taq DNA Polymerase (NEB), primers NMG-822 and NMG-823 (FIG. 21), and 400 μM each of dATP, dCTP, dGTP, and dUTP/dTTP (3:7) in 1× ThermoPol Reaction Buffer (Tm 63° C., 1.5-min extension time). The freshly generated uracil-containing DNA library fragment was purified by gel electrophoresis and extracted with QIAquick Gel Extraction Kit (Qiagen), eluting with 20 μL of H$_2$O per extraction column. The purified DNA product was digested with 2 U of USER enzyme per 40 μL in 1× CutSmart Buffer at 37° C. and monitored by analytical agarose gel electrophoresis until digestion was complete. The reaction was quenched with 10 vol of PN1 binding buffer (Qiagen) when the starting material was no longer observed (typically 3-4 h at 37° C.). Additional USER enzyme was added to the reaction if needed. The digested material was purified with QiaexII kit (Qiagen) using the manufacturer's protocol and the DNA fragments were eluted in 50 μL of pre-warmed H$_2$O per column.

The purified shuffled TadA* fragment was reassembled into full-length TadA*-XTENdCas9 product by an internal primer extension procedure. The eluted digested DNA fragments (25 μL) were combined with 4 U of Vent Polymerase (NEB), 800 μM each of dATP, dCTP, dGTP, and dTTP, 1 U of Taq DNA polymerase in 1× ThermoPol Buffer supplemented with 0.5 mM MgSO4. The thermocycler program for the reassembly procedure was the following: 94° C. for 3 min, 40 cycles of denaturation at 92° C. for 30 s, annealing over 60 s at increasing temperatures starting at 30° C. and adding 1° C. per cycle (cooling ramp=1° C./s), and extension at 72° C. for 60 s with an additional 4 s per cycle, ending with one final cycle of 72° C. for 10 min. The reassembled product was amplified by PCR with the following conditions: 15 μL of unpurified internal assembly was combined with 1 μM each of USER primers NMG-825 and NMG-826, 100 μL of Phusion U Green Multiplex PCR Master Mix and H$_2$O to a final volume of 200 μL, 63° C. annealing, extension time of 30 s. The PCR product was purified by gel electrophoresis and assembled using the USER method into the corresponding ecTadA*-XTEN-dCas9 backbone with corresponding flanking USER junctions generated from amplification of the backbone with USER primers NMG-799 and NMG-824 as before. The library of evolution 6 constructs was isolated using a ZymoPURE Plasmid Midiprep kit following the manufacturer's procedure following transformation of the hybridized library into NEB 10-beta electrocompotent *E. coli*.

Bacterial Evolution of TadA Variants.

The previously described strain S1030[51] was used in all evolution experiments and an electrocompotent version of the bacteria was prepared as previously described[49] harboring the appropriate selection plasmid specific to each round of evolution (FIG. 22). Briefly, 2 µL of freshly generated TadA* library (300-600 ng/µL) prepared as described above was added to 22 µL of freshly prepared electrocompotent S1030 cells containing the target selection plasmid and electroporated with a Lonza 4D-Nucleofector System using bacterial program 5 in a 16-well Nucleocuvette strip. A typical selection used 5-10×10$^6$ cfu. After electroporation, freshly transformed S1030 cells were recovered in a total of 250 mL of pre-warmed DRM media at 37° C. shaking at 200 rpm for 15 min. Following this brief recovery incubation, carbenicillin was added to a final concentration of 30m/mL to maintain the library plasmid, along with the appropriate antibiotic to maintain the selection plasmid; see FIG. 22 for the list of selection conditions including the antibiotics used for each round. Immediately following the addition of the plasmid maintenance antibiotics, 100 mM of L-Arabinose was added to the culture to induce translation of TadA*-dCas9 fusion library members, which were expressed from the P$_{BAD}$ promoter. The culture was grown to saturation at 37° C. with shaking at 200 rpm for 18 h, except the incubation time for evolution round 5 was only 7 h).

Library members were challenged by plating 10 mL of the saturated culture onto each of four 500-cm2 square culture dishes containing 1.8% agar-2×YT, 30m/mL of plasmid maintenance antibiotics, and a concentration of the selection antibiotic pre-determined to be above the MIC of the 51030 strain harboring the antibiotic alone (FIG. 23). Plates were incubated at 37° C. for 2 days and ~500 surviving colonies were isolated. The TadA* genes from these colonies were amplified by PCR with primers NMG-822 and NMG-823 (FIG. 21) and submitted for DNA sequencing. Concurrently, the colonies were inoculated separately into 1-mL DRM cultures in a 96-deep well plate and grown overnight at 37° C., 200 r.p.m. Aliquots (100 µL) of each overnight culture were pooled, the plasmid DNA was isolated, and the TadA* genes were amplified with USER primers NMG-825 and NMG-826 (FIG. 21). The TadA* genes were subcloned back into the plasmid backbone (containing the XTEN linker-dCas9, and appropriate guide RNAs) with the USER assembly protocol described above. This enriched library was transformed into the appropriate S1030 (+selection plasmid) electrocompotent cells, incubated with maintenance antibiotic and L-Ara and re-challenged with the selection condition. After 2-day incubation, 300-400 surviving clones were isolated as described above and their TadA* genes were sequenced. Mutations arising from each selection round were imported into mammalian ABE constructs and tested in mammalian cells as described below.

General Mammalian Cell Culture Conditions.

HEK293T (ATCC CRL-3216) and U2OS (ATTC HTB-96) were purchased from ATCC and cultured and passaged in Dulbecco's Modified Eagle's Medium (DMEM) plus GlutaMax (ThermoFisher Scientific) supplemented with 10% (v/v) fetal bovine serum (FBS). Hap1 (Horizon Discovery, C631) and Hap1 AAGcells (Horizon Discovery, HZGHC001537c002) were maintained in Iscove's Modified Dulbecco's Medium (IMDM) plus GlutaMax (ThermoFisher Scientific) supplemented with 10% (v/v) FBS. Lymphoblastoid cell lines (LCL) containing a C282Y mutation in the HFE gene (Coriell Biorepository, GM14620) were maintained in Roswell Park Memorial Institute Medium 1640 (RPMI-1640) plus GlutaMax (ThermoFisher Scientific) supplemented with 20% FBS. All cell types were incubated, maintained, and cultured at 37° C. with 5% CO$_2$.

HEK293T Tissue Culture Transfection Protocol and Genomic DNA Preparation.

HEK293T cells grown in the absence of antibiotic were seeded on 48-well poly-D-lysine coated plates (Corning). 12-14 h post-seeding, cells were transfected at approximately 70% confluency with 1.5 µL of Lipofectamine 2000 (Thermo Fisher Scientific) according to the manufacturer's protocols and 750 ng of ABE plasmid, 250 ng of sgRNA expression, and 10 ng of a GFP expression plasmid (Lonza). Unless otherwise stated, cells were cultured for 5 days, with a media change on day 3. Media was removed, cells were washed with 1×PBS solution (Thermo Fisher Scientific), and genomic DNA was extracted by addition of 100 µL freshly prepared lysis buffer (10 mM Tris-HCl, pH 7.0, 0.05% SDS, 25 µg/mL Proteinase K (ThermoFisher Scientific) directly into each well of the tissue culture plate. The genomic DNA mixture was transferred to a 96-well PCR plate and incubated at 37° C. for 1 h, followed by an 80° C. enzyme denaturation step for 30 min. Primers used for mammalian cell genomic DNA amplification are listed in FIG. 24.

Nucleofection of HAP1 and HAP1 AAG$^-$ Cells and Genomic DNA Extraction.

HAP1 and HAP1 AAG$^-$ cells were nucleofected using the SE Cell Line 4D-Nucleofector X Kit S according to the manufacturer's protocol. Briefly, 4×10$^5$ cells were nucleofected with 300 ng of ABE plasmid and 100 ng of sgRNA expression plasmid using the 4D-Nucleofector program DZ-113 and cultured in 250 µL of media in a 48-well poly-D-lysine coated culture plate for 3 days. DNA was extracted as described above.

Nucleofection of U2OS Cells and Genomic DNA Extraction.

U2OS cells were nucleofected using the SG Cell Line 4D-Nucleofector X Kit (Lonza) according to the manufacture's protocol. Briefly, 1.25×10$^5$ cells were nucleofected in 20 µL of SG buffer along with 500 ng of ABE plasmid and 100 ng of sgRNA expression plasmid using the 4D-Nucleofector program EH-100 in a 16-well Nucleocuvette strip (20 µL of cells per well). Freshly nucleofected cells were transferred into 250 µL of media in a 48-well poly-D-lysine coated culture plate. Cells were incubated for 5 days and media was changed every day. DNA was extracted as described above.

Electroporation of LCL HFE C828Y Cells.

LCL cells were electroporated using a Gene Pulser Xcell Electroporater (BioRad) and 0.4 cm gap Gene Pulser electroporation cuvettes (BioRad). Briefly, 1×10$^7$ LCL cells were resuspended in 250 µL RPMI-160 plus GlutaMax. To this media was added 65 µg of plasmid expressing ABE7.10, GFP, and the corresponding sgRNA targeting the C282Y mutation in the HFE gene. The mixture was added to a prechilled 0.4 cm gap electroporation cuvette and the cell/DNA mixture was incubated in the cuvette on ice for 10 min. Cells were pulsed at 250 V and 950 µF for 3 ms. Cells were transferred back on ice for 10 min, then transferred to 15 mL of pre-warmed RPMI-160 supplemented with 20% FBS in a T-75 flask. The next day, an additional 5 mL of media was added to the flask and cells were left to incubate for a total of 5 days. After incubation, cells were isolated by centrifugation, resuspended in 400 µL of media, filtered through a 40 µm strainer (Thermo Fisher Scientific), and sorted for GFP fluorescence using an FACSAria III Flow Cytometer (Becton Dickenson Biosciences). GFP-positive cells were collected in a 1.5-mL tube containing 500 µL of media. After centrifugation, the media was removed and cells were washed twice with 600 µL of 1×PBS (Thermo Fisher Scientific). Genomic DNA was extracted as described above.

Comparison Between ABE 7.10 and Homology Directed Repair Using the 'CORRECT' Method[52].

HEK293T cells grown in the absence of antibiotic were seeded on 48-well poly-Dlysine coated plates (Corning). After 12-14 h, cells were transfected at ~70% confluency with 750 ng of Cas9 or base editor plasmid, 250 ng of sgRNA expression plasmid, 1.5 µL of Lipofectamine 3000 (Thermo Fisher Scientific), and for HDR assays 0.7 µg of single-stranded donor DNA template (100 nt, PAGE-purified from IDT) according to the manufacturer's instructions. 100-mer single-stranded oligonucleotide donor templates are listed in FIG. 25.

Genomic DNA was harvested 48 h post-transfection (as described by Tessier-Lavigne et. al. during the development of the CORRECT method52) using the Agencourt DNAdvance Genomic DNA isolation Kit (Beckman Coulter) according to the manufacturer's instructions. A size-selective DNA isolation step ensured that there was no risk of contamination by the single-stranded donor DNA template in subsequent PCR amplification and sequencing steps. Amplification primers were re-designed to ensure there was minimal risk of amplifying donor oligo template.

High-Throughput DNA Sequencing (HTS) of Genomic DNA Samples.

Genomic sites of interest were amplified by PCR with primers containing homology to the region of interest and the appropriate Illumina forward and reverse adapters (FIG. 24). Primer pairs used in this first round of PCR (PCR 1) for all genomic sites discussed in this work can be found in FIG. 24. Specifically, 25 µL of a given PCR 1 reaction was assembled containing 0.5 µM of each forward and reverse primer, 1 µL of genomic DNA extract and 12.5 µL of Phusion U Green Multiplex PCR Master Mix. PCR reactions were carried out as follows: 95° C. for 2 min, then 30 cycles of [95° C. for 15 s, 62° C. for 20 s, and 72° C. for 20 s], followed by a final 72° C. extension for 2 min. PCR products were verified by comparison with DNA standards (Quick-Load 100 bp DNA ladder) on a 2% agarose gel supplemented with ethidium bromide. Unique Illumina barcoding primer pairs were added to each sample in a secondary PCR reaction (PCR 2). Specifically, 25 µL of a given PCR 2 reaction was assembled containing 0.5 µM of each unique forward and reverse illumine barcoding primer pair, 2 µL of unpurified PCR 1 reaction mixture, and 12.5 µL of Q5 Hot Start High-Fidelity 2× Master Mix. The barcoding PCR 2 reactions were carried out as follows: 95° C. for 2 min, then 15 cycles of [95° C. for 15 s, 61° C. for 20 s, and 72° C. for 20 s], followed by a final 72° C. extension for 2 min. PCR products were purified by electrophoresis with a 2% agarose gel using a QIAquick Gel Extraction Kit, eluting with 30 µL of H2O. DNA concentration was quantified with the KAPA Library Quantification Kit-Illumina (KAPA Biosystems) and sequenced on an Illumina MiSeq instrument according to the manufacturer's protocols.

General HTS Data Analysis.

Sequencing reads were demultiplexed in MiSeq Reporter (Illumina). Alignment of amplicon sequences to a reference sequence was performed as previously described using a Matlab script with improved output format (Supplementary Note 1). In brief, the Smith-Waterman algorithm was used to align sequences without indels to a reference sequence; bases with a quality score less than 30 were converted to 'N' to prevent base miscalling as a result of sequencing error. Indels were quantified separately using a modified version of a previously described Matlab script in which sequencing reads with more than half the base calls below a quality score of Q30 were filtered out (Supplementary Note 2). Indels were counted as reads which contained insertions or deletions of greater than or equal to 1 bp within a 30-bp window surrounding the predicted Cas9 cleavage site.

Due to homology in the HBG1 and HBG2 loci, primers were designed that would amplify both loci within a single PCR reaction. In order to computationally separate sequences of these two genomic sites, sequencing experiments involving this amplicon were processed using a separate Python script (Supplementary Note 3). Briefly, reads were disregarded if more than half of the base calls were below Q30, and base calls with a quality score below Q30 were converted to 'N'. HBG1 or HBG2 reads were identified as having an exact match to a 37-bp sequence containing two SNPs that differ between the sites. A base calling and indel window were defined by exact matches to 10-bp flanking sequences on both sides of a 43-bp window centered on the protospacer sequence. Indels were counted as reads in which this base calling window was ≥1 bp different in length. This Python script yields output with identical quality (estimated base calling error rate of <1 in 1,000), but in far less time due to the absence of an alignment step.

To calculate the total number of edited reads as a proportion of the total number of successfully sequenced reads, the fraction of edited reads as measured by the alignment algorithm were multiplied by [1−fraction of reads containing an indel].

Linkage Disequlilbrium Analysis.

A custom Python script (Supplementary Note 4) was used to assess editing probabilities at the primary target A ($P_1$) at the secondary target A (P2), and at both the primary and secondary target As (P1,2). Linkage disequilibrium (LD) was then evaluated as $P_{1,2}−(P_1×P_2)$. LD values were normalized with a normalization factor of $Min(P_1(1−P_2), (1−P_1)P_2)$. This normalization which controls for allele frequency and yields a normalized LD value from 0 to 1.

Figure 15:
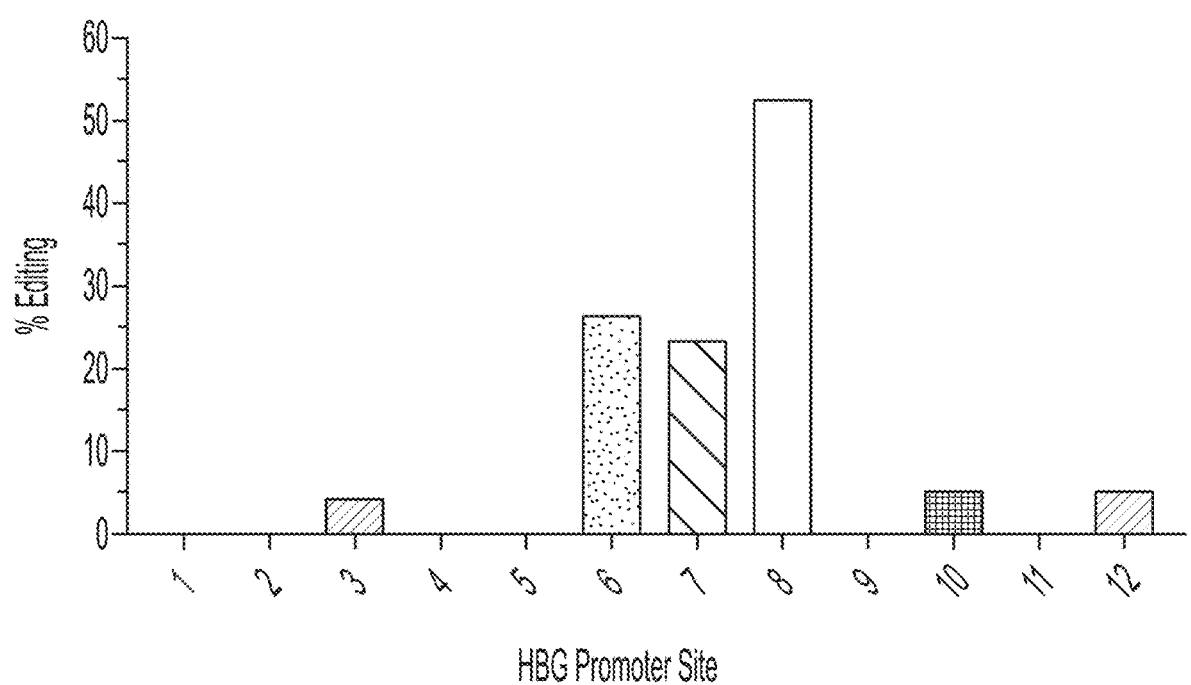
FIG. 15 shows base editing data using the base editor ABE 7.10 and 12 gRNAs that target the promotor region of HBG1/2. The identity of the gRNA target sequences are (1) SEQ ID NO: 259, (2) SEQ ID NO: 260 (3) SEQ ID NO: 266, (4) SEQ ID NO: 267, (5) SEQ ID NO: 268, (6) SEQ ID NO: 269, (7) SEQ ID NO: 270, (8) SEQ ID NO: 276, (9) SEQ ID NO: 277, (10) SEQ ID NO: 278, (11) SEQ ID NO: 279, and (12) SEQ ID NO: 280.

Example 7—ABE-Mediated Installation of Mutations in the HBG1/2 Promoter to Treat Human Disease, Such as Sickle Cell and Beta-Thalassemia The sgRNAs indicated in FIG. 15 target sites in the HBG1/2 promoters, primarily focused on sites at or near known mutations that confer fetal hemoglobin upregulation in adults. ABE 7.10 and individual sgRNA plasmids (750 ng of editor, 250 ng of guide) were lipofected into HEK293T cells. After three days of expression in HEK293T cells, media was aspirated and fresh media was added. Following two more days of growth, DNA was extracted. PCR was conducted to amplify the HBG1/2 promoter regions. PCR products were sequenced using an Illumina MiSeq, and edits were quantified for each sample. Plotted in FIG. 15 is the highest editing observed within the window for cells treated with the indicated guide. These results establish that mutations can be introduced that could upregulate fetal hemoglobin in adults. The introduction of such mutations could be therapeutic for sickle cell disease and beta thalassemia.

REFERENCES

1 Krokan, H. E., Drablos, F. & Slupphaug, G. Uracil in DNA—occurrence, consequences and repair. Oncogene 21, 8935-8948, doi:10.1038/sj.onc.1205996 (2002).

2. Lewis, C. A., Crayle, J., Zhou, S., Swanstrom, R. & Wolfenden, R. Cytosine deamination and the precipitous decline of spontaneous mutation during Earth's history. Proc Natl Acad Sci USA 113, 8194-8199, doi:10.1073/pnas.1607580113 (2016).
3. Komor, A. C., Badran, A. H. & Liu, D. R. Editing the Genome Without Double-Stranded DNA Breaks. ACS Chemical Biology, doi:10.1021/acschembio.7b00710 (2017).
4. Nishida, K. et al. Targeted nucleotide editing using hybrid prokaryotic and vertebrate adaptive immune systems. Science, doi:10.1126/science.aaf8729 (2016).
5. Kuscu, C. & Adli, M. CRISPR-Cas9-AID base editor is a powerful gain-of-function screening tool. Nature Methods 13, 983-984, doi:10.1038/nmeth.4076 (2016).
6. Komor, A. C., Kim, Y. B., Packer, M. S., Zuris, J. A. & Liu, D. R. Programmable editing of a target base in genomic DNA without double-stranded DNA cleavage. Nature 533, 420-424, doi:10.1038/nature17946 (2016).
7. Kim, Y. B. et al. Increasing the genome-targeting scope and precision of base editing with engineered Cas9-cytidine deaminase fusions. Nat Biotech 35, 371-376, doi:10.1038/nbt.3803 (2017).
8. Rees, H. A. et al. Improving the DNA specificity and applicability of base editing through protein engineering and protein delivery. Nat Commun 8, 15790, doi:10.1038/ncomms15790 (2017).
9. Komor, A. C. et al. Improved Base Excision Repair Inhibition and Bacteriophage Mu Gam Protein Yields C:G-to-T:A Base Editors with Higher Efficiency and Product Purity. Science Advances In press (2017).
10. Satomura, A. et al. Precise genome-wide base editing by the CRISPR Nickase system in yeast. Scientific reports 7, 2095, doi:10.1038/s41598-017-02013-7 (2017).
11. Lu, Y. & Zhu, J.-K. Precise Editing of a Target Base in the Rice Genome Using a Modified CRISPR/Cas9 System. Mol Plant 10, 523-525, doi:10.1016/j.molp.2016.11.013 (2017).
12. Zong, Y. et al. Precise base editing in rice, wheat and maize with a Cas9-cytidine deaminase fusion. Nat Biotech 35, 438-440, doi:10.1038/nbt.3811 (2017).
13. Zhang, Y. et al. Programmable base editing of zebrafish genome using a modified CRISPR-Cas9 system. Nature communications 8, 118, doi:10.1038/s41467-017-00175-6 (2017).
14. Billon, P. et al. CRISPR-Mediated Base Editing Enables Efficient Disruption of Eukaryotic Genes through Induction of STOP Codons. Molecular cell 67, 1068-1079.e1064, doi:10.1016/j.molcel.2017.08.008 (2017).
15. Kuscu, C. et al. CRISPR-STOP: gene silencing through base-editing-induced nonsense mutations. Nat Meth 14, 710-712, doi:10.1038/nmeth.4327 (2017).
16. Kim, K. et al. Highly efficient RNA-guided base editing in mouse embryos. Nat Biotech 35, 435-437, doi:10.1038/nbt.3816 (2017).
17. Chadwick, A. C., Wang, X. & Musunuru, K. In Vivo Base Editing of PCSK9 (Proprotein Convertase Subtilisin/Kexin Type 9) as a Therapeutic Alternative to Genome Editing. Arteriosclerosis, thrombosis, and vascular biology 37, 1741-1747, doi:10.1161/ATVBAHA.117.309881 (2017).
18. Liang, P. et al. Correction of β-thalassemia mutant by base editor in human embryos. Protein & cell 12, 61-12, doi:10.1007/s13238-017-0475-6 (2017).
19. Li, G. et al. Highly efficient and precise base editing in discarded human tripronuclear embryos. Protein & cell 532, 289-284, doi:10.1007/s13238-017-0458-7 (2017).
20. Tang, W., Hu, J. H. & Liu, D. R. Aptazyme-embedded guide RNAs enable ligandresponsive genome editing and transcriptional activation. 8, 15939, doi:10.1038/ncomms15939 (2017).
21. Yasui, M. et al. Miscoding properties of 2'-deoxyinosine, a nitric oxide-derived DNA Adduct, during translesion synthesis catalyzed by human DNA polymerases. Journal of Molecular Biology 377, 1015-1023, doi:10.1016/j.jmb.2008.01.033 (2008).
22. Zheng, Y., Lorenzo, C. & Beal, P. A. DNA editing in DNA/RNA hybrids by adenosine deaminases that act on RNA. Nucleic acids research 45, 3369-3377, doi:10.1093/nar/gkx050 (2017).
23. Rubio, M. A. T. et al. An adenosine-to-inosine tRNA-editing enzyme that can perform C-to-U deamination of DNA. Proc Natl Acad Sci USA 104, 7821-7826, doi:10.1073/pnas.0702394104 (2007).
24. Kim, J. et al. Structural and Kinetic Characterization of *Escherichia coli* TadA, the Wobble-Specific tRNA Deaminase Biochemistry 45, 6407-6416, doi:10.1021/bi0522394 (2006).
25. Wolf, J. G., A. P.; Keller, W. tadA, an essential tRNA-specic adenosine deaminase from *Escherichia coli*. EMBO 21, 3841-3851 (2002).
26. Malashkevich, V. et al. Crystal structure of tRNA adenosine deaminase TadA from *Escherichia coli*. doi:10.2210/pdb1z3a/pdb (2006).
27. Matthews, M. M. et al. Structures of human ADAR2 bound to dsRNA reveal baseflipping mechanism and basis for site selectivity. Nature Structural &amp; Molecular Biology, 1-10, doi:10.1038/nsmb.3203 (2016).
28. George, C. X., Gan, Z., Liu, Y. & Samuel, C. E. Adenosine Deaminases Acting on RNA, RNA Editing, and Interferon Action. Journal of Interferon & Cytokine Research 31, 99-117, doi:10.1089/jir.2010.0097 (2011).
29. Grunebaum, E., Cohen, A. & Roifman, C. M. Recent advances in understanding and managing adenosine deaminase and purine nucleoside phosphorylase deficiencies. Current Opinion in Allergy and Clinical Immunology 13, 630-638, doi:10.1097/ACI.0000000000000006 (2013).
30. Maas, S., Gerber, A. P. & Rich, A. Identification and characterization of a human tRNA-specific adenosine deaminase related to the ADAR family of pre-mRNA editing enzymes. Proceedings of the National Academy of Sciences of the United States of America 96, 8895-8900, doi:10.1073/pnas.96.16.8895 (1999).
31. Gerber, A. P. An Adenosine Deaminase that Generates Inosine at the Wobble Position of tRNAs. Science 286, 1146-1149, doi:10.1126/science.286.5442.1146 (1999).
32. Fukui, K. DNA Mismatch Repair in Eukaryotes and Bacteria. Journal of Nucleic Acids 2010, 1-16, doi:10.4061/2010/260512 (2010).
33. Shi, K. et al. Structural basis for targeted DNA cytosine deamination and mutagenesis by APOBEC3A and APOBEC3B. Nature Structural & Molecular Biology 24, 131-139, doi:10.1038/nsmb.3344 (2016).
34. Macbeth, M. R. Inositol Hexakisphosphate Is Bound in the ADAR2 Core and Required for RNA Editing. Science 309, 1534-1539, doi:10.1126/science.1113150 (2005).

35 Losey, H. C., Ruthenburg, A. J. & Verdine, G. L. Crystal Structure of *Staphylococcus aureus* tRNA Adenosine Deaminase, TadA, in Complex with RNA. doi:10.2210/pdb2b3j/pdb (2006).
36 Saparbaev, M. & Laval, J. Excision of hypoxanthine from DNA containing dIMP residues by the *Escherichia coli*, yeast, rat, and human alkylpurine DNA glycosylases. Proceedings of the National Academy of Sciences of the United States of America 91, 5873-5877, doi:10.1073/pnas.91.13.5873 (1994).
37 Engelward, B. P. et al. Base excision repair deficient mice lacking the Aag alkyladenine DNA glycosylase. Proceedings of the National Academy of Sciences of the United States of America 94, 13087-13092, doi:10.1073/pnas.94.24.13087 (1997).
38 Lau, A. Y., Wyatt, M. D., Glassner, B. J., Samson, L. D. & Ellenberger, T. Molecular basis for discriminating between normal and damaged bases by the human alkyladenine glycosylase, AAG. Proceedings of the National Academy of Sciences of the United States of America 97, 13573-13578, doi:10.1073/pnas.97.25.13573 (2000).
39 Sebastian Vik, E. et al. Endonuclease V cleaves at inosines in RNA. Nature communications 4, 16260, doi:10.1038/ncomms3271 (2013).
40 Losey, H. C., Ruthenburg, A. J. & Verdine, G. L. Crystal structure of *Staphylococcus aureus* tRNA adenosine deaminase TadA in complex with RNA. Nature Structural & Molecular Biology 13, 153-159, doi:10.1038/nsmb1047 (2006).
41 Kwart, D., Paquet, D., Teo, S. & Tessier-Lavigne, M. Precise and efficient scarless genome editing in stem cells using CORRECT. Nat. Protocols 12, 329-354, doi:10.1038/nprot.2016.171 (2017).
42 Park, J. et al. Digenome-seq web tool for profiling CRISPR specificity. Nature Methods 14, 548-549, doi:10.1038/nmeth.4262 (2017).
43 Tsai, S. Q. et al. GUIDE-seq enables genome-wide profiling of off-target cleavage by CRISPR-Cas nucleases. Nature Biotechnology 33, 187-197, doi:10.1038/nbt.3117 (2015).
44 Traxler, E. A. et al. A genome-editing strategy to treat β-hemoglobinopathies that recapitulates a mutation associated with a benign genetic condition. Nature medicine 22, 987-990, doi:10.1038/nm.4170 (2016).
45 Akinsheye, I. et al. Fetal hemoglobin in sickle cell anemia. Blood 118, 19-27, doi:10.1182/blood-2011-03-325258 (2011).
46 Wienert, B. et al. KLF1 drives the expression of fetal hemoglobin in British HPFH. Blood 130, 803-807, doi:10.1182/blood-2017-02-767400 (2017).
47 Townsend, A. & Drakesmith, H. Role of HFE in iron metabolism, hereditary haemochromatosis, anaemia of chronic disease, and secondary iron overload. The Lancet 359, 786-790, doi:10.1016/50140-6736(02)07885-6 (2002).
48 Alexander, J. & Kowdley, K. V. HFE-associated hereditary hemochromatosis. Genetics in Medicine 11, 307-313, doi:10.1097/GIM.0b013e31819d30f2 (2009).
49 Badran, A. H. et al. Continuous evolution of *Bacillus thuringiensis* toxins overcomes insect resistance. Nature 533, 58-63, doi:10.1038/nature17938 (2016).
50 Muller, K. M. Nucleotide exchange and excision technology (NExT) DNA shuffling: a robust method for DNA fragmentation and directed evolution. Nucleic acids research 33, e117-e117, doi:10.1093/nar/gni116 (2005).
51 Esvelt, K. M., Carlson, J. C. & Liu, D. R. A system for the continuous directed evolution of biomolecules. Nature 472, 499-503, doi:10.1038/nature09929 (2011).
52 Paquet, D. et al. Efficient introduction of specific homozygous and heterozygous mutations using CRISPR/Cas9. Nature 533, 125-129, doi:10.1038/nature17664 (2016).

Supplementary Sequences 1.

DNA sequences of adenine deaminases used in this study.

Bacterial codon-optimized ecTadA (wild-type):
(SEQ ID NO: 31)
ATGTCTGAAGTCGAATTTAGCCACGAATACTGGATGCGTCACGCGCTGA
CGCTGGCGAAACGTGCCTGGGATGAGCGGGAAGTGCCGGTCGGCGCGGT
ATTAGTGCATAACAATCGGGTAATCGGCGAAGGCTGGAACCGCCCGATT
GGTCGCCATGATCCCACCGCACATGCAGAAATCATGGCCCTGCGGCAGG
GTGGTCTGGTGATGCAAAATTATCGTCTGATCGACGCCACGTTGTATGT
CACGCTTGAACCATGTGTAATGTGTGCCGGAGCGATGATCCACAGTCGC
ATTGGTCGCGTGGTCTTTGGTGCGCGTGACGCGAAAACTGGCGCTGCGG
GATCTTTAATGGATGTGCTGCATCATCCGGGTATGAATCACCGAGTGGA
AATTACGGAAGGAATACTGGCGGATGAGTGCGCGGCGTTGCTCAGTGAC
TTCTTTCGCATGCGCCGCCAGGAAATTAAAGCGCAGAAAAAAGCGCAAT
CCTCGACGGAT Mammalian codon-optimized ecTadA (wild-type):
(SEQ ID NO: 32)
ATGTCCGAAGTCGAGTTTTCCCATGAGTACTGGATGAGACACGCATTGA
CTCTCGCAAAGAGGGCTTGGGATGAACGCGAGGTGCCCGTGGGGGCAGT
ACTCGTGCATAACAATCGCGTAATCGGCGAAGGTTGGAATAGGCCGATC
GGACGCCACGACCCCACTGCACATGCGGAAATCATGGCCCTTCGACAGG
GAGGGCTTGTGATGCAGAATTATCGACTTATCGATGCGACGCTGTACGT
CACGCTTGAACCTTGCGTAATGTGCGCGGGAGCTATGATTCACTCCCGC
ATTGGACGAGTTGTATTCGGTGCCCGCGACGCCAAGACGGGTGCCGCAG
GTTCACTGATGGACGTGCTGCATCACCCAGGCATGAACCACCGGGTAGA
AATCACAGAAGGCATATTGGCGGACGAATGTGCGGCGCTGTTGTCCGAC
TTTTTTCGCATGCGGAGGCAGGAGATCAAGGCCCAGAAAAAAGCACAAT
CCTCTACTGAC Mammalian codon-optimized mADA:
(SEQ ID NO: 33)
ATGGCCCAGACACCCGCATTCAACAAACCCAAAGTAGAGTTACACGTCC
ACCTGGATGGAGCCATCAAGCCAGAAACCATCTTATACTTTGGCAAGAA
GAGAGGCATCGCCCTCCCGGCAGATACAGTGGAGGAGCTGCGCAACATT
ATCGGCATGGACAAGCCCCTCTCGCTCCCAGGCTTCCTGGCCAAGTTTG
ACTACTACATGCCTGTGATTGCGGGCTGCAGAGAGGCCATCAAGAGGAT
CGCCTACGAGTTTGTGGAGATGAAGGCAAAGGAGGGCGTGGTCTATGTG
GAAGTGCGCTATAGCCCACACCTGCTGGCCAATTCCAAGGTGGACCCAA
TGCCCTGGAACCAGACTGAAGGGGACGTCACCCCTGATGACGTTGTGGA
TCTTGTGAACCAGGGCCTGCAGGAGGGAGAGCAAGCATTTGGCATCAAG
GTCCGGTCCATTCTGTGCTGCATGCGCCACCAGCCCAGCTGGTCCCTTG -continued

AGGTGTTGGAGCTGTGTAAGAAGTACAATCAGAAGACCGTGGTGGCTAT

GGACTTGGCTGGGGATGAGACCATTGAAGGAAGTAGCCTCTTCCCAGGC

CACGTGGAAGCCTATGAGGGCGC

AGTAAAGAATGGCATTCATCGGACCGTCCACGCTGGCGAGGTGGGCTCT

CCTGAGGTTGTGCGTGAGGCTGTGGACATCCTCAAGACAGAGAGGGTGG

GACATGGTTATCACACCATCGAGGATGAAGCTCTCTACAACAGACTACT

GAAAGAAAACATGCACTTTGAGGTCTGCCCCTGGTCCAGCTACCTCACA

GGCGCCTGGGATCCCAAAACGACGCATGCGGTTGTTCGCTTCAAGAATG

ATAAGGCCAACTACTCACTCAACACAGACGACCCCCTCATCTTCAAGTC

CACCCTAGACACTGACTACCAGATGACCAAGAAAGACATGGGCTTCACT

GAGGAGGAGTTCAAGCGACTGAACATCAACGCAGCGAAGTCAAGCTTCC

TCCCAGAGGAAGAGAAGAAGGAACTTCTGGAACGGCTCTACAGAGAATA

CCAA

Mammalian codon optimized hADAR2 (catalytic domain):
(SEQ ID NO: 41)
ATGCATCTCGATCAAACCCCGAGCCGCCAACCAATCCCGAGTGAAGGCC

TGCAACTGCATCTGCCACAAGTTCTGGCGGATGCCGTTAGCCGCCTGGT

CTTGGGTAAGTTCGGTGATCTGACAGACAACTTTTCTAGTCCACATGCT

CGCCGTAAGGTGCTGGCTGGCGTTGTGATGACCACAGGTACAGACGTCA

AAGATGCTAAAGTGATTTCTGTGTCTACTGGCACGAAGTGCATTAACGG

CGAATATATGTCTGACCGTGGCTTAGCGCTTAACGATTGTCATGCCGAA

ATCATCTCCCGTCGTTCATTGCTTCGCTTCCTGTACACGCAGTTGGAAC

TGTATCTGAATAACAAAGACGATCAGAAGCGTTCTATTTTCCAGAAGTC

TGAGCGCGGCGGGTTCCGTCTTAAAGAGAATGTGCAGTTTCACCTTTAT

ATTTCAACCTCTCCTTGTGGTGATGCCCGTATTTTTTCACCACACGAAC

CTATTTTAGAGGAACCGGCCGATCGTCATCCGAACCGCAAAGCCCGTGG

GCAGCTGCGTACGAAAATCGAATCAGGTGAAGGCACCATTCCCGTCCGC

TCCAATGCGAGCATTCAAACGTGGGACGGTGTGTTACAGGGCGAACGCC

TGTTAACCATGAGCTGCTCAGACAAAATTGCACGTTGGAACGTGGTAGG

CATCCAGGGCTCGTTATTGAGCATTTTCGTGGAGCCGATTTATTTTAGT

TCCATCATTTTGGGCTCACTCTACCACGGCGATCACCTTAGCCGCGCGA

TGTACCAGCGCATTAGTAACATCGAAGATTTACCGCCCCTGTATACCCT

GAACAAACCACTGTTAAGCGGTATTTCTAACGCGGAGGCGCGTCAGCCT

GGTAAAGCCCCGAACTTCAGTGTGAACTGGACTGTGGGTGATTCTGCAA

TTGAGGTAATTAACGCGACGACGGGTAAAGATGAACTGGGCCGTGCCTC

TCGTCTGTGTAAACACGCGCTGTACTGTCGTTGGATGCGCGTGCACGGT

AAAGTTCCCAGTCATCTGTTACGTAGCAAGATCACCAAGCCAAATGTCT

ACCACGAATCGAAGCTGGCCGCGAAAGAATACCAAGCGGCTAAGGCGCG

TCTGTTCACCGCCTTTATTAAGGCTGGCTTAGGGGCCTGGGTGGAAAAA

CCAACCGAGCAAGATCAATTCAGTCTGACCCCG

Mammalian codon optimized hADAT2:
(SEQ ID NO: 42)
ATGGAGGCGAAGGCGGCACCCAAGCCAGCTGCAAGCGGCGCGTGCTCGG

TGTCGGCAGAGGAGACCGAAAAGTGGATGGAGGAGGCGATGCACATGGC

CAAAGAAGCCCTCGAAAATACTGAAGTTCCTGTTGGCTGTCTTATGGTC

TACAACAATGAAGTTGTAGGGAAGGGGAGAAATGAAGTTAACCAAACCA

AAAATGCTACTCGACATGCAGAAATGGTGGCCATCGATCAGGTCCTCGA

TTGGTGTCGTCAAAGTGGCAAGAGTCCCTCTGAAGTATTTGAACACACT

GTGTTGTATGTCACTGTGGAGCCGTGCATTATGTGTGCAGCTGCTCTCC

GCCTGATGAAAATCCCGCTGGTTGTATATGGCTGTCAGAATGAACGATT

TGGTGGTTGTGGCTCTGTTCTAAATATTGCCTCTGCTGACCTACCAAAC

ACTGGGAGACCATTTCAGTGTATCCCTGGATATCGGGCTGAGGAAGCAG

TGGAAATGTTAAAGACCTTCTACAAACAAGAAAATCCAAATGCACCAAA

ATCGAAAGTTCGGAAAAAGGAATGTCAGAAATCT

Supplementary Sequences 2.

DNA sequences of antibiotic resistance genes used in this study. Inactivating mutations are shown in bold.

Chloramphenicol resistance gene (Cam$^R$) H193Y:
(SEQ ID NO: 43)
ATGGAGAAAAAAATCACTGGATATACCACCGTTGATATATCCCAATGGCA

TCGTAAAGAACATTTTGAGGCATTTCAGTCAGTTGCTCAATGTACCTATA

ACCAGACCGTTCAGCTGGATATTACGGCCTTTTTAAAGACCGTAAAGAAA

AATAAGCACAAGTTTTATCCGGCCTTTATTCACATTCTTGCCCGCCTGAT

GAATGCTCATCCGGAGTTCCGTATGGCAATGAAAGACGGTGAGCTGGTGA

TATGGGATAGTGTTCACCCTTGTTACACCGTTTTCCATGAGCAAACTGAA

ACGTTTTCATCGCTCTGGAGTGAATACCACGACGATTTCCGGCAGTTTCT

ACACATATATTCGCAAGATGTGGCGTGTTACGGTGAAAACCTGGCCTATT

TCCCTAAAGGGTTTATTGAGAATATGTTTTTCGTCTCAGCCAATCCCTGG

GTGAGTTTCACCAGTTTTGATTTAAACGTGGCCAATATGGACAACTTCTT

CGCCCCCGTTTTCACTATGGGCAAATATTATACGCAAGGCGACAAGGTGC

TGATGCCGCTGGCCATCCAGGTGCACTACGCCGTATGCGACGGCTTCCAT

GTCGGCAGAATGCTTAATGAATTACAACAGTACTGCGATGAGTGGCAGGG

CGGGGCGTAA

Kanamycin resistance gene (Kan$^R$) Q4STOP and W15STOP:
(SEQ ID NO: 44)
ATGATCGAATAAGATGGATTGCACGCAGGTTCTCCGGCCGCTTAGGTGGA

GCGCCTATTCGGCTATGACTGGGCACAACAGACAATCGGCTGCTCTGATG

CCGCCGTGTTCCGGCTGTCAGCGCAGGGGCGCCCGGTTCTTTTTGTCAAG

ACCGACCTGTCCGGTGCCCTGAATGAACTGCAGGACGAGGCAGCGCGGCT

ATCGTGGCTGGCCACGACGGGCGTTCCTTGCGCAGCTGTGCTCGACGTTG

TCACTGAAGCGGGAAGGGACTGGCTGCTATTGGGCGAAGTGCCGGGGCAG

GATCTCCTGTCATCTCACCTTGCTCCTGCCGAGAAAGTATCCATCATGGC

TGATGCAATGCGGCGGCTGCATACGCTTGATCCGGCTACCTGCCCATTCG

-continued

ACCACCAAGCGAAACATCGCATCGAGCGAGCACGTACTCGGATGGAAGCC

GGTCTTGTCGATCAGGATGATCTGGACGAAGAGCATCAGGGGCTCGCGCC

AGCCGAACTGTTCGCCAGGCTCAAGGCGCGCATGCCCGACGGCGAGGATC

TCGTCGTGACCCATGGCGATGCCTGCTTGCCGAATATCATGGTGGAAAAT

GGCCGCTTTTCTGGATTCATCGACTGTGGCCGGCTGGGTGTGGCGGACCG

CTATCAGGACATAGCGTTGGCTACCCGTGATATTGCTGAAGAGCTTGGCG

GCGAATGGGCTGACCGCTTCCTCGTGCTTTACGGTATCGCCGCTCCCGAT

TCGCAGCGCATCGCCTTCTATCGCCTTCTTGACGAGTTCTTCTAA

Spectinomycin resistance gene (Spect$^R$) T89I:
(SEQ ID NO: 45)
ATGAGGGAAGCGGTGATCGCCGAAGTATCGACTCAACTATCAGAGGTAGT

TGGCGTCATCGAGCGCCATCTCGAACCGACGTTGCTGGCCGTACATTTGT

ACGGCTCCGCAGTGGATGGCGGCCTGAAGCCACACAGTGATATTGATTTG

CTGGTTACGGTGACCGTAAGGCTTGATGAAACAACGCGGCGAGCTTTGAT

CAACGACCTTTTGGAAACTTCGGCTTCCCCTGGAGAGAGCGAGATTCTCC

GCGCTGTAGAAGTCATCATTGTTGTGCACGACGACATCATTCCGTGGCGT

TATCCAGCTAAGCGCGAACTGCAATTTGGAGAATGGCAGCGCAATGACAT

TCTTGCAGGTATCTTCGAGCCAGCCACGATCGACATTGATCTGGCTATCT

TGCTGACAAAAGCAAGAGAACATAGCGTTGCCTTGGTAGGTCCAGCGGCG

GAGGAACTCTTTGATCCGGTTCCTGAACAGGATCTATTTGAGGCGCTAAA

TGAAACCTTAACGCTATGGAACTCGCCGCCCGACTGGGCTGGCGATGAGC

GAAATGTAGTGCTTACGTTGTCCCGCATTTGGTACAGCGCAGTAACCGGC

AAAATCGCGCCGAAGGATGTCGCTGCCGACTGGGCAATGGAGCGCCTGCC

GGCCCAGTATCAGCCCGTCATACTTGAAGCTAGACAGGCTTATCTTGGAC

AAGAAGAAGATCGCTTGGCCTCGCGCGCAGATCAGTTGGAAGAATTTGTC

CACTACGTGAAAGGCGAGATCACCAAGGTAGTCGGCAAATAA

Kanamycin resistance gene (Kan$^R$) Q4STOP and D208N:
(SEQ ID NO: 46)
ATGATCGAATAAGATGGATTGCACGCAGGTTCTCCGGCCGCTTGGGTGGA

GAGGCTATTCGGCTATGACTGGGCACAACAGACAATCGGCTGCTCTGATG

CCGCCGTGTTCCGGCTGTCAGCGCAGGGGCGCCCGGTTCTTTTTGTCAAG

ACCGACCTGTCCGGTGCCCTGAATGAACTGCAGGACGAGGCAGCGCGGCT

ATCGTGGCTGGCCACGACGGGCGTTCCTTGCGCAGCTGTGCTCGACGTTG

TCACTGAAGCGGGAAGGGACTGGCTGCTATAGCCGGCCACAGTTAATGAA

TGGGCGAAGTGCCGGGGCAGGATCTCCTGTCATCTCACCTTGCTCCTGCC

GAGAAAGTATCCATCATGGCTGATGCAATGCGGCGGCTGCATACGCTTGA

TCCGGCTACCTGCCCATTCGACCACCAAGCGAAACATCGCATCGAGCGAG

CACGTACTCGGATGGAAGCCGGTCTTGTCGATCAGGATGATCTGGACGAA

GAGCATCAGGGGCTCGCGCCAGCCGAACTGTTCGCCAGGCTCAAGGCGCG

CATGCCCGACGGCGAGGATCTCGTCGTGACCCATGGCGATGCCTGCTTGC

CGAATATCATGGTGGAAAATGGCCGCTTTTCTGGATTCATTAACTGTGGC

CGGCTGGGTGTGGCGGACCGCTATCAGGACATAGCGTTGGCTACCCGTGA

TATTGCTGAAGAGCTTGGCGGCGAATGGGCTGACCGCTTCCTCGTGCTTT

ACGGTATCGCCGCTCCCGATTCGCAGCGCATCGCCTTCTATCGCCTTCTT

GACGAGTTCTTCTAA

Supplementary Note 1.
Matlab script for base calling.

```
function basecall(WTnuc, directory)
%cycle through fastq files for different samples cd directory
files=dir('*.fastq'); for d=1:2
filename=files(d).name;
%read fastq file
[header,seqs,qscore] = fastqread(filename);
seqsLength = length(seqs);     % number of sequences seqsFile = strrep(filename,'.fastq','');
    % trims off .fastq
%create a directory with the same name as fastq file if exist(seqsFile,'dir');
error('Directory already exists. Please rename or move it before moving on.');
end
mkdir(seqsFile);          % make directory
wtLength = length(WTnuc);    % length of wildtype sequence
%% aligning back to the wildtype nucleotide sequence
%
% AlN is a matrix of the nucleotide alignment window=1:wtLength;
sBLength = length(seqs);       % number of sequences
% counts number of skips nSkips = 0;
ALN=repmat('',[sBLength wtLength]);
% iterate through each sequencing read for i = 1:sBLength
%If you only have forward read fastq files leave as is
%If you have R1 foward and R2 is reverse fastq files uncomment the
%next four lines of code and the subsequent end statement
%    if mod(d,2)==0;
%    reverse = seqrcomplement(seqs{i});
%    [score,alignment,start] = swalign(reverse,WTnuc,'Alphabet','NT');
%    else
[score,alignment,start] = swalign(seqs{i},WTnuc,'Alphabet','NT');
%    end
% length of the sequencing read len = length(alignment(3,:));
% if there is a gap in the alignment , skip = 1 and we will
% throw away the entire read skip = 0;
for j = 1:len
```

-continued

```
if (alignment(3,j) == '-' || alignment(1,j) == '-') skip = 1;
break;
letters)
end
%in addition if the qscore for any given base in the read is
%below 31 the nucleotide is turned into an N (fastq qscores that are not
if isletter(qscore{i}(start(1)+j-1)) else
alignment(1,j) = 'N';
end
end
if skip == 0 && len>10
ALN(i, start(2):(start(2)+length(alignment)-1))=alignment(1,:);
end
end
% with the alignment matrices we can simply tally up the occurrences of
% each nucleotide at each column in the alignment these
% tallies ignore bases annotated as N
% due to low qscores TallyNTD=zeros(5,wtLength); FreqNTD=zeros(4,wtLength);
SUM=zeros(1,wtLength);
for i=1:wtLength
TallyNTD(:,i)=[sum(ALN(:,i)=='A'),sum(ALN(:,i)=='C'),sum(ALN(:,i)=='G'),sum(ALN(:,i)=='T'),sum(ALN(:,i)=='N')];
end
for i=1:wtLength FreqNTD(:,i)=100*TallyNTD(1:4,i)/sum(TallyNTD(1:4,i));
end
for i=1:wtLength SUM(:,i)=sum(TallyNTD(1:4,i));
end
% we then save these tally matrices in the respective folder for
% further processing
save(strcat(seqsFile, '/TallyNTD'), 'TallyNTD');
dlmwrite(strcat(seqsFile, '/TallyNTD.csv'), TallyNTD, 'precision', '%.3f', 'newline', 'pc');
save(strcat(seqsFile, '/FreqNTD'), 'FreqNTD');
dlmwrite(strcat(seqsFile, '/FreqNTD.csv'), FreqNTD, 'precision', '%.3f', 'newline', 'pc');
fid = fopen('FrequencySummary.csv', 'a'); fprintf(fid, '\n \n');
fprintf(fid, filename); fprintf(fid, '\n \n');
dlmwrite('FrequencySummary.csv', FreqNTD, 'precision', '%.3f', 'newline', 'pc','- append');
dlmwrite('FrequencySummary.csv', SUM, 'precision', '%.3f', 'newline', 'pc','- append');
end
% set up queue of basecalling runs
% change directory to folder of fastq files for a given target site
cd('/Users/michaelpacker/Documents/MATLAB/BaseCallingWithSummary') cd
PUTFOLDERNAMEHERE
% call upon the basecall program basecall(PUTWTSEQUENCEHERE)
% and repeat cd('/Users/michaelpacker/Documents/MATLAB/BaseCallingWithSummary')
cd PUTFOLDERNAMEHERE
basecall(PUTWTSEQUENCEHERE)
% and repeat...
```

Supplementary Note 2.
Matlab script for indel analysis.

```
%WTnuc='CGGTGGGAGGTCTATATAAGCAGAGCTGGTTTAGTGAACCGTCAGATC
CGCTAGAGATCCGCGGCCGCTAATACGACTCAC
CCTAGGGAGAGCCGCCACCGTGGTGAGCAAGGGCGAGGAGCTGTTCACCGGGGT
GGTGCCCATCCTGGTCGAGCTGGACGGCGACGTAA
ACGGCCACAAGTTCAGCGTGTCCGGCGAG';
%cycle through fastq files for different samples files=dir('*.fastq');
indelstart=55; width=30; flank=10;
(SEQ ID NO: 85)

for d=1:2
filename=files(d).name;
%read fastq file
[header,seqs,qscore]=fastqread(filename);
seqsLength=length(seqs); % number of sequences
seqsFile=strcat(strrep(filename,'.fastq',''),'_INDELS'); % trims off .fastq
%create a directory with the same name as fastq file+_INDELS if exist(seqsFile,'dir');
error('Directory already exists. Please rename or move it before moving on.');
end
mkdir(seqsFile); % make directory
wtLength=length(WTnuc); % length of wildtype sequence sBLength=length(seqs); %
number of sequences
```

```
% initialize counters and cell arrays nSkips=0;
notINDEL=0;
ins={};
dels={}; NumIns=0; NumDels=0;
% iterate through each sequencing read for i=1:sBLength
%search for 10 BP sequences that should flank both sides of the "INDEL WINDOW"
window start=strfind(seqs{i},WTnuc(indelstart-flank:indelstart));
windowend=strfind(seqs{i},WTnuc(indelstart+width:indelstart+width+flank));
%if these flanks are found and more than half of base calls
%are above Q31 THEN proceed OTHERWISE save as a skip if length(windowstart)==1 &&
length(windowend)==1 &&
(sum(isletter(qscore{i}))/length(qscore{ii}))>=0.5

%if the sequence length matches the INDEL window length save as
%not INDEL
if windowend-windowstart==width+flank notINDEL=notINDEL+1;
%if the sequence is ONE or more baseslonger than the INDEL
%window length save as an Insertion
elseif windowend-windowstart>=width+flank+1 NumIns=NumIns+1;
ins{NumIns}=seqs{i};
%if the sequence is ONE or more bases shorter than the INDEL
%window length save as a Deletion
elseif windowend-windowstart<=width+flank-1 NumDels=NumDels+1;
dels{NumDels}=seqs{i};
end
%keep track of skipped sequences that do not posess matching flank
%sequences and do not pass quality cutoff else
nSkips=nSkips+1;

end end INDELrate=(NumIns+NumDels)/(NumIns+NumDels+notINDEL)*100.; FID =
fopen('INDELSummary.csv','a');
fprintf(FID, '\n \n'); fprintf(FID, filename); fprintf(FID, '\n');
fprintf(FID, num2str(INDELrate));

fid=fopen(strcat(seqsFile, '/summary.txt'), 'wt');
fprintf(fid, 'Skipped reads %i\n not INDEL %i\n Insertions %i\n Deletions %]n INDEL
percent %e\n', [nSkips, notINDEL, NumIns, NumDels,INDELrate]);
fclose(fid);
save(strcat(seqsFile, '/nSkips'), 'nSkips'); save(strcat(seqsFile, '/notINDEL'), 'notINDEL');
save(strcat(seqsFile, '/NumIns'), 'NumIns'); save(strcat(seqsFile, '/NumDels'), 'NumDels');
save(strcat(seqsFile, '/INDELrate'), 'INDELrate'); save(strcat(seqsFile, '/dels'), 'dels');
C=dels;
fid=fopen(strcat(seqsFile, '/dels.txt'), 'wt'); fprintf(fid, '"%s"\n', C{:});
fclose(fid);
save(strcat(seqsFile, '/ins'), 'ins'); C=ins;
fid = fopen(strcat(seqsFile, '/ins.txt'), 'wt'); fprintf(fid, '"%s"\n', C{:});
fclose(fid);
```

Supplementary Note 3.
Python script for analysis of HBG1 and HBG2 base editing and indels.

```
%matplotlib inline import numpy as np import scipy as sp import matplotlib as mpl
import matplotlib.cm as cm import matplotlib.pyplot as plt import pandas as pd
pd.set_option('display.width', 500)
pd.set_option('display.max columns', 100) pd.set option('display.notebook_repr_html',
True) import seaborn as sns
sns.set_style("whitegrid") sns.set_context("poster") import requests
import time
from bs4 import BeautifulSoup import regex
import re import os
from Bio import SeqIO import Bio
from Bio import motifs from Bio import pairwise2
from Bio.pairwise2 import format_alignment from Bio.Alphabet import IUPAC
from sklearn import preprocessing basecall analysis with 50% Q31 cutoff on protospacer region (as defined by flanks)
includes a check for match with two HB G1 SNPs
#inputs:
#directory, working directory folder containing all fastq files
#site, genomic site name as it appears in the fastq filenames
#orientation, 'FWD' if you want output in the same direction as the sequencing read or 'REV'
if you want reverse complement output,
```

```
#flank1, sequence that is used to define the 5' end of protospacer in the sequencing read
direction,
#flank2, sequence that is used to define the 5' end of protospacer in the sequencing read
direction,
#width, expected bp length of basecalling window

#outputs:
#'_counts.csv', all base editing product sequences with corresponding number of occurences
#'_rawsummary.csv', summarizes base call counts for all samples
#'_normalizedsummary.csv', summarizes base call percentages for all samples def
basecallhbg1(directory, site, orientation, flank1, flank2, width):
indir=directory outdir=directory filenames=os.listdir(indir)
for i in range(len(filenames)): seqs={}
if (filenames[i][-5:]==Tastq') and (site in filenames[i]): for record in
SeqIO.parse(indir+filenames[i], "fastq"):
recordqual,[x > 31 for x in record.letter_annotations['phred quality]]
#only process reads that have more than half of basecalls >Q31 and contain two HBG1
specific SNPs at 3' end of read
if (record.seq.find(GTTTTTCTCTAATTTATTCTTCCCTTTAGCTAGTTTC') > 0) and
(float(sum(recordqual))/float(len(recordqual)) > =.5):
recordseq=".join([y if x else 'N' for (x,y) in zip(recordqual,
record.seq)])
(SEQ ID NO: 86)

record.seq)])

first item recordseq=".joingy if x else 'N' for (x,y) in zip(recordqual, split prior to spacer window split1=recordseq.split(flank1) if len(split1)==2:
take second item in first split
split again at the sequence right after the protospacer and take split2=split1[1].split(flank2)[0]
keep only entries with exact width if (len(Split2)==width):
if orientation=='FWD': seqs[record.id],split2
elif orientation=='REV': seqs[record.id]=Bio.Seq.reverse_complement(Split2)
frame=pd.DataFrame({'Spacer':seqs.values()}, index=seqs.keys())
Motif=motifs.create(frame.Spacer.values, alphabet=IUPAC.IUPACAmbiguousDNA())
raw=pd.DataFrame(Motif.counts, index,[str(s+1) for s in
range(width)])[['A','C','G','T','N']].transpose() normalized=pd.DataFrame(Motif.counts,
index,[str(s+1) for s in
range(width)])D[['A','C','G','T']].transpose()
normalized=normalized/normalized.sum(axis=0)*100. normalized=normalized.round(2)
Counts=pd.DataFrame(seqs.items(), columns=['ID','Window']) Counts=Counts[['N', not in x
for x in Counts.Window]]
Counts=Counts.groupby('Window').count().sort_values('ID', ascending=False)
Counts.to_csv(outdir+filenames[i].strip('.fastq')+'_hbg1.csv')
fd=open(directory+site+'_normalizedsummary_hbg1.csv','a') fd.write('\n'+filenames[i]+'\n')
normalized.to_csv(fd) fd.close()
fd=open(directory+site+'_rawsummary_hbg1.csv','a') fd.write('\n'+filenames[i]+'\n')
raw.to_csv(fd) fd.close()
return basecall analysis with 50% Q31 cutoff on protospacer region (as defined by flanks)
includes a check for match with two HBG2 SNPs
#inputs:
#directory, working directory folder containing all fastq files
#site, genomic site name as it appears in the fastq filenames
#orientation, 'FWD' if you want output in the same direction as the sequencing read or 'REV'
if you want reverse complement output,
flank1, sequence that is used to define the 5' end of protospacer in the sequencing read
direction,
#flank2, sequence that is used to define the 5' end of protospacer in the sequencing read
direction,
#width, expected bp length of basecalling window

#outputs:
#'_counts.csv', all base editing product sequences with corresponding number of occurences
#'_rawsummary.csv', summarizes base call counts for all samples
#'_normalizedsummary.csv', summarizes base call percentages for all samples def
basecallhbg2(directory, site, orientation, flank1, flank2, width):
indir=directory outdir=directory filenames=oslistdir(indir)
for i in range(len(filenames)): seqs={}
if (filenames[i][-5:]=='fastq') and (site in filenames[i]):
```

-continued

```
for record in SeqIO.parse(indir+filenames[i], "fastq"):
recordqual=[x > 31 for x in record.letter_annotations['phred_quality']]
#only process reads that have more than half of basecalls >Q31 and contain two HBG2
specific SNPs at 3' end of read
if (record.seq.find('ATTTTTCTCTAATTTATTCTTCCCTTTAGCTAGTTTT') > 0) and
(float(sum(recordqual))/float(len(recordqual)) > =.5):
recordseq="".join([y if x else 'N' for (x,y) in zip(recordqual,
(SEQ ID NO: 87)

record.seq)])

first item split prior to spacer window split1=recordseq.split(flank1) if len(split1)==2:
take second item in first split
split again at the sequence right after the protospacer and take split2=split1[1].split(flank2)[0]
keep only entries with exact width if (len(Split2)==width):
if orientation=='FWD': seqs[record.id]=split2
elif orientation=='REV': seqs[record.id]=Bio.Seq.reverse_complement(Split2)

frame=pd.DataFrame({'Spacer':seqs.values()}, index=seqs.keys())
Motif=motifs.create(frame.Spacer.values, alphabet=IUPAC.IUPACAmbiguousDNA())
raw=pd.DataFrame(Motif.counts, index,[str(s+1) for s in
range(width)])[['A','C','G','T','N']].transpose() normalized=pd.DataFrame(Motif.counts,
index,[str(s+1) for s in
range(width)])[['A',C,'G','T']].transpose()
normalized=normalized/normalized.sum(axis=0)*100. normalized=normalized.round(2)
Counts=pd.DataFrame(seqs.items(), columns=['ID','Window']) Counts=Counts[['N', not in x
for x in Counts.Window]]
Counts=Counts.groupby('Window').count().sort_values('ID', ascending=False)
Counts.to_csv(outdir+filenames[i+].strip('.fastq')+'_hbg2.csv')
fd=open(directory+site+'_normalizedsummary_hbg2.csv','a') fd.write('\n+filenames[i]+'\n')
normalized.to_csv(fd) fd.close()
fd=open(directory+site+'_rawsummary_hbg2.csv','a') fd.write('\n'+filenames[i]+'\n')
raw.to_csv(fd) fd.close()
return indel analysis
includes a check for match with two HBG1 SNPs
#inputs:
#directory, working directory folder containing all fastq files
#site, genomic site name as it appears in the fastq filenames
#orientation, 'FWD' if you want output in the same direction as the sequencing read or 'REV'
if you want reverse complement output,
flank1, sequence that is used to define the 5' end of protospacer in the sequencing read
direction,
#flank2, sequence that is used to define the 5' end of protospacer in the sequencing read
direction,
#width, expected bp length of basecalling window
#ouputs:
#"_Insertions_hbg1.csv", sequences of all insertion reads
#"_deletions_hbg1.csv", sequences of all deletion reads
#'indelsummary_hbg1.csv', contains all indel stats for all fastq files def indelshbg1(directory,
site, flank1, flank2, width):
indir=directory outdir=directory filenames=os.listdir(indir)
for i in range(len(filenames)): seqs={}
if (filenames[i][-5:]=='fastq') and (site in filenames[i]): skips=0
ins=0 insertions=[] dels=0 deletions=[] notindel=0
for record in SeqIO.parse(indir+filenames[i], "fastq"):
recordqual=[x > 31 for x in record.letter_annotations['phred quality']]
#only process reads that have more than half of basecalls >Q31 and contain two HBG1
specific SNPs at 3' end of read
if (record.seq.find(GTTTTTCTCTAATTTATTCTTCCCTTTAGCTAGTTTC') > 0) (SEQ ID
NO: 88) and
(float(sum(recordqual))/float(len(recordqual))>=.5):
#split prior to indel window split1=record.seq.split(flank1) if len(split1)==2:
#take second item in first split
#split again at the sequence right after the indel window if len(split1[1].split(flank2))==2:
split2=split1[1].split(flank2)[0]
#if INDEL window is +1 add to Insertions if (len(Split2)>=width+1):
ins=ins+1 insertions.append(split2)
#if INDEL window is -1 add to Deletions if (len(Split2)<=width-1):
dels=dels+1 deletions.append(split2)
if len(Split2)==width: notindel=notindel+1
```

```
else:
skips=skips+1
else:
skips=skips+1
else:
skips=skips+1 fd=open(directory+'indelsummary_hbg1.csv','a')
fd.write('\n'+filenames[i]+'\n') fd.write('skipped reads: '+str(skips)+'\n') fd.write('insertions:
'+str(ins)+'\n') fd.write('deletions: '+str(dels)+'\n') fd.write('notindels: '\str(notindel)+'\'n')
fd.write('indel rate:
'+str(float(ins+dels)/float(ins+dels+notindel)*100.)+'%'+'\n') fd.close()
pd.DataFrame(insertions).to_csv(directory+filenames[i]+'Insertions_hbg1.csv')
pd.DataFrame(deletions).to_csv(directory+filenames[i]+'Deletions_hbg1.csv')
return indel analysis
includes a check for match with two HBG2 SNPs
#inputs:
#directory, working directory folder containing all fastq files
#site, genomic site name as it appears in the fastq filenames
#orientation, 'FWD' if you want output in the same direction as the sequencing read or 'REV'
if you want reverse complement output, flank1, sequence that is used to define the 5' end of protospacer in the sequencing read
direction,
#flank2, sequence that is used to define the 5' end of protospacer in the sequencing read
direction,
#width, expected bp length of basecalling window
#ouputs:
#"_Insertions_hbg2.csv", sequences of all insertion reads
#"_deletions_hbg2.csv", sequences of all deletion reads
#'indelsummary_hbg2.csv', contains all indel stats for all fastq files def indelshbg2(directory,
site, flank1, flank2, width):
indir=directory outdir=directory filenames=os.listdir(indir)
for i in range(len(filenames)): seqs={}
if (filenames[i][-5:]=='fastq') and (site in filenames[i]): skips=0
ins=0 insertions=[] dels=0 deletions=[] notindel=0
for record in SeqIO.parse(indir+filenames[i], "fastq":
recordqual=[x > 31 for x in record.letter_annotations['phred_quality']]
#only process reads that have more than half of basecalls >Q31 and contain two HBG2
specific SNPs at 3' end of read
if (record.seq.find('ATTTTTCTCTAATTTATTCTTCCCTTTAGCTAGTTTT') > 0) (SEQ ID
NO: 89) and
(float(sum(recordqual))/float(len(recordqual))>=.5):
#split prior to indel window split1=record.seq.split(flank1) if len(split1)==2:
#take second item in first split
#split again at the sequence right after the indel window if len(split1[1].split(flank2))==2:
split2=split1[1].split(flank2)[0]
#if INDEL window is +1 add to Insertions if (len(Split2)>=width+1):
ins=ins+1 insertions.append(split2)
#if INDEL window is -1 add to Deletions if (len(Split2)<=width-1):
dels=dels+1 deletions.append(split2)
if len(Split2)==width: notindel=notindel+1
else:
skips=skips+1
else:
skips=skips+1
else:
skips=skips+1 fd=open(directory+'indelsummary_hbg2.csv','a')
fd.write('\n'+filenames[i]+'\n') fd.write('skipped reads: '+str(skips)+'\n') fd.write('insertions:
'+str(ins)+'\n') fd.write('deletions: '+str(dels)+'\n') fd.write('notindels: '+str(notindel)+'\n')
fd.write('indel rate:
'(float(ins+dels)/float(ins+dels+notindel)*100.)+'%'+'\n') fd.close()
pd.DataFrame(insertions).to_csv(directory+filenames[i]+'Insertions_hbg2.csv')
pd.DataFrame(deletions).to_csv(directory+filenames[i]+'Deletions_hbg2.csv')
return directory1='/Users/michaelpacker/Desktop/Liu_Lab/MiSeqData/y-globin_632/'
basecallhbg1(directory1, '632', 'FWD','ATTTGCA','TTAATTTTTT' (SEQ ID NO: 90), 43)
basecallhbg2(directory1, '632', 'FWD','ATTTGCA','TTAATTTTTT' (SEQ ID NO: 90), 43)
indelshbg1(directory1, '632','ATTTGCA','TTAATTTTTT' (SEQ ID NO: 90),43)
indelshbg2(directory1, '632','ATTTGCA','TTAATTTTTT' (SEQ ID NO: 90),43
```

EQUIVALENTS AND SCOPE, INCORPORATION BY REFERENCE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (871 sequences)

SEQ ID NO: 1 - protein, 167 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - DNA, 23 bp, Artificial Sequence
  Synthetic polynucleotide
gtggggaaggggcccccaagagg

SEQ ID NO: 3 - DNA, 26 bp, Artificial Sequence
  Synthetic polynucleotide
tatacgtaccaggtggagcacccagg

SEQ ID NO: 4 - protein, 7 aa, Artificial Sequence
  Synthetic polynucleotide
PKKKRKV

SEQ ID NO: 5 - protein, 30 aa, Artificial Sequence
  Synthetic polypeptide
MDSLLMNRRKFLYQFKNVRWAKGRRETYLC

SEQ ID NO: 6 - DNA, 27 bp, Artificial Sequence
  Synthetic polynucleotide
cctcttgggggccccttccccacacta

SEQ ID NO: 7 - DNA, 26 bp, Artificial Sequence
  Synthetic polynucleotide
cctcttgggggccccttccccacact

SEQ ID NO: 8 - protein, 160 aa, Artificial Sequence
  Synthetic polypeptide
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 9 - protein, 161 aa, Artificial Sequence
  Synthetic polypeptide
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 10 - protein, 16 aa, Artificial Sequence
  Synthetic polypeptide
SGSETPGTSESATPES

SEQ ID NO: 11 - protein, 1561 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 12 - protein, 1561 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 13 - protein, 1561 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 14 - protein, 1561 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 15 - DNA, 25 bp, Artificial Sequence
  Synthetic polynucleotide
cctcttgggggccccttccccacac

SEQ ID NO: 16 - DNA, 24 bp, Artificial Sequence
  Synthetic polynucleotide
cctcttgggggccccttccccaca

SEQ ID NO: 17 - DNA, 23 bp, Artificial Sequence
  Synthetic polynucleotide
cctcttgggggccccttccccac

SEQ ID NO: 18 - DNA, 22 bp, Artificial Sequence
  Synthetic polynucleotide
cctcttgggggccccttcccca

SEQ ID NO: 19 - DNA, 21 bp, Artificial Sequence
  Synthetic polynucleotide
cctcttgggggccccttcccc

SEQ ID NO: 20 - DNA, 20 bp, Artificial Sequence
  Synthetic polynucleotide
cctcttgggggccccttccc

SEQ ID NO: 21 - DNA, 27 bp, Artificial Sequence
  Synthetic polynucleotide
cctgggtgctccacctggtacgtatat

SEQ ID NO: 22 - DNA, 26 bp, Artificial Sequence
  Synthetic polynucleotide
cctgggtgctccacctggtacgtata

SEQ ID NO: 23 - DNA, 25 bp, Artificial Sequence
  Synthetic polynucleotide
cctgggtgctccacctggtacgtat

SEQ ID NO: 24 - DNA, 24 bp, Artificial Sequence
  Synthetic polynucleotide
cctgggtgctccacctggtacgta

SEQ ID NO: 25 - DNA, 23 bp, Artificial Sequence
  Synthetic polynucleotide
cctgggtgctccacctggtacgt

SEQ ID NO: 26 - DNA, 22 bp, Artificial Sequence
  Synthetic polynucleotide
cctgggtgctccacctggtacg

SEQ ID NO: 27 - protein, 1550 aa, Artificial Sequence
  Synthetic polypeptide
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1550 aa, Artificial Sequence
  Synthetic polypeptide
  misc_feature (155)..(155): Xaa can be any naturally occurring amino acid
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQXIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - DNA, 21 bp, Artificial Sequence
  Synthetic polynucleotide
cctgggtgctccacctggtac

SEQ ID NO: 30 - DNA, 20 bp, Artificial Sequence
  Synthetic polynucleotide
cctgggtgctccacctggta

SEQ ID NO: 31 - DNA, 501 bp, Artificial Sequence
  Synthetic polynucleotide
atgtctgaagtcgaatttagccacgaatactggatgcgtcacgcgctgacgctggcgaaacgtgcctgggatgagcgggaagtgccggtcggcgcggtattagtgcataacaatcgggtaatcggcgaaggctggaaccgcccgattggtcgccatgatcccaccgcacatgcagaaatcatggccctgcggcagggtggtctggtgatgcaaaattatcgtctgatcgacgccacgttgtatgtcacgcttgaaccatgtgtaatgtgtgccggagcgatgatccacagtcgcattggtcgcgtggtctttggtgcgcgtgacgcgaaaactggcgctgcgggatctttaatggatgtgctgcatcatccgggtatgaatcaccgagtggaaattacggaaggaatactggcggatgagtgcgcggcgttgctcagtgacttctttcgcatgcgccgccaggaaattaaagcgcagaaaaaagcgcaatcctcgacggat

SEQ ID NO: 32 - DNA, 501 bp, Artificial Sequence
  Synthetic polynucleotide
atgtccgaagtcgagttttcccatgagtactggatgagacacgcattgactctcgcaaagagggcttgggatgaacgcgaggtgcccgtgggggcagtactcgtgcataacaatcgcgtaatcggcgaaggttggaataggccgatcggacgccacgaccccactgcacatgcggaaatcatggcccttcgacagggagggcttgtgatgcagaattatcgacttatcgatgcgacgctgtacgtcacgcttgaaccttgcgtaatgtgcgcgggagctatgattcactcccgcattggacgagttgtattcggtgcccgcgacgccaagacgggtgccgcaggttcactgatggacgtgctgcatcacccaggcatgaaccaccgggtagaaatcacagaaggcatattggcggacgaatgtgcggcgctgttgtccgacttttttcgcatgcggaggcaggagatcaaggcccagaaaaaagcacaatcctctactgac

SEQ ID NO: 33 - DNA, 1056 bp, Artificial Sequence
  Synthetic polynucleotide
atggcccagacacccgcattcaacaaacccaaagtagagttacacgtccacctggatggagccatcaagccagaaaccatcttatactttggcaagaagagaggcatcgccctcccggcagatacagtggaggagctgcgcaacattatcggcatggacaagcccctctcgctcccaggcttcctggccaagtttgactactacatgcctgtgattgcgggctgcagagaggccatcaagaggatcgcctacgagtttgtggagatgaaggcaaaggagggcgtggtctatgtggaagtgcgctatagcccacacctgctggccaattccaaggtggacccaatgccctggaaccagactgaaggggacgtcacccctgatgacgttgtggatcttgtgaaccagggcctgcaggagggagagcaagcatttggcatcaaggtccggtccattctgtgctgcatgcgccaccagcccagctggtcccttgaggtgttggagctgtgtaagaagtacaatcagaagaccgtggtggctatggacttggctggggatgagaccattgaaggaagtagcctcttcccaggccacgtggaagcctatgagggcgcagtaaagaatggcattcatcggaccgtccacgctggcgaggtgggctctcctgaggttgtgcgtgaggctgtggacatcctcaagacagagagggtgggacatggttatcacaccatcgaggatgaagctctctacaacagactactgaaagaaaacatgcactttgaggtctgcccctggtccagctacctcacaggcgcctgggatcccaaaacgacgcatgcggttgttcgcttcaagaatgataaggccaactactcactcaacacagacgaccccctcatcttcaagtccaccctagacactgactaccagatgaccaagaaagacatgggcttcactgaggaggagttcaagcgactgaacatcaacgcagcgaagtcaagcttcctcccagaggaagagaagaaggaacttctggaacggctctacagagaataccaa

SEQ ID NO: 34 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Artificial Sequence
  Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 120 aa, Artificial Sequence
  Synthetic polypeptide
  MISC_FEATURE (5)..(120): May be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 38 - protein, 120 aa, Artificial Sequence
  Synthetic polypeptide
  MISC_FEATURE (5)..(120): May be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 39 - protein, 150 aa, Artificial Sequence
  Synthetic polypeptide
  MISC_FEATURE (6)..(150)
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 40 - protein, 150 aa, Artificial Sequence
  Synthetic polypeptide
  MISC_FEATURE (6)..(150)
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 41 - DNA, 1209 bp, Artificial Sequence
  Synthetic polynucleotide
atgcatctcgatcaaaccccgagccgccaaccaatcccgagtgaaggcctgcaactgcatctgccacaagttctggcggatgccgttagccgcctggtcttgggtaagttcggtgatctgacagacaacttttctagtccacatgctcgccgtaaggtgctggctggcgttgtgatgaccacaggtacagacgtcaaagatgctaaagtgatttctgtgtctactggcacgaagtgcattaacggcgaatatatgtctgaccgtggcttagcgcttaacgattgtcatgccgaaatcatctcccgtcgttcattgcttcgcttcctgtacacgcagttggaactgtatctgaataacaaagacgatcagaagcgttctattttccagaagtctgagcgcggcgggttccgtcttaaagagaatgtgcagtttcacctttatatttcaacctctccttgtggtgatgcccgtattttttcaccacacgaacctattttagaggaaccggccgatcgtcatccgaaccgcaaagcccgtgggcagctgcgtacgaaaatcgaatcaggtgaaggcaccattcccgtccgctccaatgcgagcattcaaacgtgggacggtgtgttacagggcgaacgcctgttaaccatgagctgctcagacaaaattgcacgttggaacgtggtaggcatccagggctcgttattgagcattttcgtggagccgatttattttagttccatcattttgggctcactctaccacggcgatcaccttagccgcgcgatgtaccagcgcattagtaacatcgaagatttaccgcccctgtataccctgaacaaaccactgttaagcggtatttctaacgcggaggcgcgtcagcctggtaaagccccgaacttcagtgtgaactggactgtgggtgattctgcaattgaggtaattaacgcgacgacgggtaaagatgaactgggccgtgcctctcgtctgtgtaaacacgcgctgtactgtcgttggatgcgcgtgcacggtaaagttcccagtcatctgttacgtagcaagatcaccaagccaaatgtctaccacgaatcgaagctggccgcgaaagaataccaagcggctaaggcgcgtctgttcaccgcctttattaaggctggcttaggggcctgggtggaaaaaccaaccgagcaagatcaattcagtctgaccccg

SEQ ID NO: 42 - DNA, 573 bp, Artificial Sequence
  Synthetic polynucleotide
atggaggcgaaggcggcacccaagccagctgcaagcggcgcgtgctcggtgtcggcagaggagaccgaaaagtggatggaggaggcgatgcacatggccaaagaagccctcgaaaatactgaagttcctgttggctgtcttatggtctacaacaatgaagttgtagggaaggggagaaatgaagttaaccaaaccaaaaatgctactcgacatgcagaaatggtggccatcgatcaggtcctcgattggtgtcgtcaaagtggcaagagtccctctgaagtatttgaacacactgtgttgtatgtcactgtggagccgtgcattatgtgtgcagctgctctccgcctgatgaaaatcccgctggttgtatatggctgtcagaatgaacgatttggtggttgtggctctgttctaaatattgcctctgctgacctaccaaacactgggagaccatttcagtgtatccctggatatcgggctgaggaagcagtggaaatgttaaagaccttctacaaacaagaaaatccaaatgcaccaaaatcgaaagttcggaaaaaggaatgtcagaaatct

SEQ ID NO: 43 - DNA, 660 bp, Artificial Sequence
  Synthetic polynucleotide
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggccatccaggtgcactacgccgtatgcgacggcttccatgtcggcagaatgcttaatgaattacaacagtactgcgatgagtggcagggcggggcgtaa

SEQ ID NO: 44 - DNA, 795 bp, Artificial Sequence
  Synthetic polynucleotide
atgatcgaataagatggattgcacgcaggttctccggccgcttaggtggagcgcctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 45 - DNA, 792 bp, Artificial Sequence
  Synthetic polynucleotide
atgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcatcattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataa

SEQ ID NO: 46 - DNA, 815 bp, Artificial Sequence
  Synthetic polynucleotide
atgatcgaataagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctatagccggccacagttaatgaatgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcattaactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 47 - DNA, 4104 bp, Artificial Sequence
  Synthetic polynucleotide
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 48 - protein, 1367 aa, Artificial Sequence
  Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - DNA, 4212 bp, Artificial Sequence
  Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 50 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - DNA, 4107 bp, Artificial Sequence
  Synthetic polynucleotide
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 52 - protein, 1368 aa, Artificial Sequence [sequence omitted]

SEQ ID NO: 53 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1368 aa, Artificial Sequence; identical to SEQ ID NO: 53
  Synthetic polypeptide

SEQ ID NO: 55 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 56 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 57 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 58 - protein, 1367 aa, Artificial Sequence; identical to SEQ ID NO: 36
  Synthetic polypeptide

SEQ ID NO: 59 - protein, 1367 aa, Artificial Sequence; identical to SEQ ID NO: 35
  Synthetic polypeptide

SEQ ID NO: 60 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 61 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 62 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 63 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 64 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 65 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 66 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 67 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 68 - protein, 166 aa, Artificial Sequence
  Synthetic polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 69 - protein, 166 aa, Artificial Sequence
  Synthetic polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 70 - protein, 166 aa, Artificial Sequence
  Synthetic polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 71 - protein, 166 aa, Artificial Sequence
  Synthetic polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 72 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 73 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 74 - protein, 166 aa, Artificial Sequence
  Synthetic polypeptide
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 75 - protein, 166 aa, Artificial Sequence
  Synthetic polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 76 - protein, 166 aa, Artificial Sequence
  Synthetic polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 77 - protein, 166 aa, Artificial Sequence
  Synthetic polypeptide
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 78 - protein, 166 aa, Artificial Sequence
  Synthetic polypeptide
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 79 - protein, 166 aa, Artificial Sequence
  Synthetic polypeptide
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 80 - protein, 166 aa, Artificial Sequence
  Synthetic polypeptide
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 81 - protein, 166 aa, Artificial Sequence
  Synthetic polypeptide
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 82 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 83 - protein, 166 aa, Artificial Sequence
  Synthetic polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 84 - protein, 178 aa, Artificial Sequence
  Synthetic polypeptide
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 85 - DNA, 199 bp, Artificial Sequence
  Synthetic polynucleotide
cggtgggaggtctatataagcagagctggtttagtgaaccgtcagatccgctagagatccgcggccgctaatacgactcaccctagggagagccgccaccgtggtgagcaagggcgaggagctgttcaccggggtggtgcccatcctggtcgagctggacggcgacgtaaacggccacaagttcagcgtgtccggcgag

SEQ ID NO: 86 - DNA, 37 bp, Artificial Sequence
  Synthetic polynucleotide
gtttttctctaatttattcttccctttagctagtttc

SEQ ID NO: 87 - DNA, 37 bp, Artificial Sequence
  Synthetic polynucleotide
atttttctctaatttattcttccctttagctagtttt

SEQ ID NO: 88 - DNA, 37 bp, Artificial Sequence; identical to SEQ ID NO: 86
  Synthetic polynucleotide

SEQ ID NO: 89 - DNA, 37 bp, Artificial Sequence; identical to SEQ ID NO: 87
  Synthetic polynucleotide

SEQ ID NO: 90 - DNA, 10 bp, Artificial Sequence
  Synthetic polynucleotide
ttaatttttt

SEQ ID NO: 91 - DNA, 23 bp, Artificial Sequence
  Synthetic polynucleotide
gaacacaaagcatagactgcggg

SEQ ID NO: 92 - DNA, 23 bp, Artificial Sequence
  Synthetic polynucleotide
gagtatgaggcatagactgcagg

SEQ ID NO: 93 - DNA, 23 bp, Artificial Sequence
  Synthetic polynucleotide
gtcaagaaagcagagactgccgg

SEQ ID NO: 94 - DNA, 23 bp, Artificial Sequence
  Synthetic polynucleotide
gagcaaagacaatagactgtagg

SEQ ID NO: 95 - DNA, 23 bp, Artificial Sequence
  Synthetic polynucleotide
gatgagataatgatgagtcaggg

SEQ ID NO: 96 - DNA, 23 bp, Artificial Sequence
  Synthetic polynucleotide
ggattgacccaggccagggctgg

SEQ ID NO: 97 - DNA, 23 bp, Artificial Sequence
  Synthetic polynucleotide
gaatactaagcatagactccagg

SEQ ID NO: 98 - DNA, 23 bp, Artificial Sequence
  Synthetic polynucleotide
gtaaacaaagcatagactgaggg

SEQ ID NO: 99 - DNA, 23 bp, Artificial Sequence
  Synthetic polynucleotide
gaagaccaaggatagactgctgg

SEQ ID NO: 100 - DNA, 23 bp, Artificial Sequence
  Synthetic polynucleotide
gaacataaagaatagaatgatgg

SEQ ID NO: 101 - DNA, 23 bp, Artificial Sequence
  Synthetic polynucleotide
ggacaggcagcatagactgtggg

SEQ ID NO: 102 - DNA, 23 bp, Artificial Sequence
  Synthetic polynucleotide
gtagaaaaagtatagactgcagg

SEQ ID NO: 103 - DNA, 23 bp, Artificial Sequence
  Synthetic polynucleotide
gaagatagagaatagactgctgg

SEQ ID NO: 104 - DNA, 23 bp, Artificial Sequence
  Synthetic polynucleotide
ggctaaagaccatagactgtggg

SEQ ID NO: 105 - DNA, 23 bp, Artificial Sequence
  Synthetic polynucleotide
gtctagaaagcttagactgctgg

SEQ ID NO: 106 - DNA, 22 bp, Artificial Sequence
  Synthetic polynucleotide
gggaataatcatagaatcctgg

SEQ ID NO: 107 - DNA, 23 bp, Artificial Sequence
  Synthetic polynucleotide
gacaaagaggaagagagacgggg

SEQ ID NO: 108 - DNA, 23 bp, Artificial Sequence
  Synthetic polynucleotide
acacacacacttagaatctgtgg

SEQ ID NO: 109 - DNA, 23 bp, Artificial Sequence
  Synthetic polynucleotide
cacacacacttagaatctgtggg

SEQ ID NO: 110 - DNA, 23 bp, Artificial Sequence
  Synthetic polynucleotide
acacacacacttagaatctgtgg

SEQ ID NO: 111 - DNA, 23 bp, Artificial Sequence
  Synthetic polynucleotide
cacacacacttagaatctgtggg

SEQ ID NO: 112 - DNA, 22 bp, Artificial Sequence
  Synthetic polynucleotide
ggtgtttcgtcctttccacaag

SEQ ID NO: 113 - DNA, 55 bp, Artificial Sequence
  Synthetic polynucleotide
gaacacaaagcatagactgcgttttagagctagaaatagcaagttaaaataaggc

SEQ ID NO: 114 - DNA, 55 bp, Artificial Sequence
  Synthetic polynucleotide
gagtatgaggcatagactgcgttttagagctagaaatagcaagttaaaataaggc

SEQ ID NO: 115 - DNA, 55 bp, Artificial Sequence
  Synthetic polynucleotide
gtcaagaaagcagagactgcgttttagagctagaaatagcaagttaaaataaggc

SEQ ID NO: 116 - DNA, 55 bp, Artificial Sequence
  Synthetic polynucleotide
gagcaaagagaatagactgtgttttagagctagaaatagcaagttaaaataaggc

SEQ ID NO: 117 - DNA, 55 bp, Artificial Sequence
  Synthetic polynucleotide
gatgagataatgatgagtcagttttagagctagaaatagcaagttaaaataaggc

SEQ ID NO: 118 - DNA, 55 bp, Artificial Sequence
  Synthetic polynucleotide
ggattgacccaggccagggcgttttagagctagaaatagcaagttaaaataaggc

SEQ ID NO: 119 - DNA, 55 bp, Artificial Sequence
  Synthetic polynucleotide
gaatactaagcatagactccgttttagagctagaaatagcaagttaaaataaggc

SEQ ID NO: 120 - DNA, 55 bp, Artificial Sequence
  Synthetic polynucleotide
gtaaacaaagcatagactgagttttagagctagaaatagcaagttaaaataaggc

SEQ ID NO: 121 - DNA, 55 bp, Artificial Sequence
  Synthetic polynucleotide
gaagaccaaggatagactgcgttttagagctagaaatagcaagttaaaataaggc

SEQ ID NO: 122 - DNA, 55 bp, Artificial Sequence
  Synthetic polynucleotide
gaacataaagaatagaatgagttttagagctagaaatagcaagttaaaataaggc

SEQ ID NO: 123 - DNA, 55 bp, Artificial Sequence
  Synthetic polynucleotide
ggacaggcagcatagactgtgttttagagctagaaatagcaagttaaaataaggc

SEQ ID NO: 124 - DNA, 55 bp, Artificial Sequence
  Synthetic polynucleotide
gtagaaaaagtatagactgcgttttagagctagaaatagcaagttaaaataaggc

SEQ ID NO: 125 - DNA, 55 bp, Artificial Sequence
  Synthetic polynucleotide
gaagatagagaatagactgcgttttagagctagaaatagcaagttaaaataaggc

SEQ ID NO: 126 - DNA, 55 bp, Artificial Sequence
  Synthetic polynucleotide
ggctaaagaccatagactgtgttttagagctagaaatagcaagttaaaataaggc

SEQ ID NO: 127 - DNA, 55 bp, Artificial Sequence
  Synthetic polynucleotide
gtctagaaagcttagactgcgttttagagctagaaatagcaagttaaaataaggc

SEQ ID NO: 128 - DNA, 55 bp, Artificial Sequence
  Synthetic polynucleotide
gggaataaatcatagaatccgttttagagctagaaatagcaagttaaaataaggc

SEQ ID NO: 129 - DNA, 55 bp, Artificial Sequence
  Synthetic polynucleotide
gacaaagaggaagagagacggttttagagctagaaatagcaagttaaaataaggc

SEQ ID NO: 130 - DNA, 56 bp, Artificial Sequence
  Synthetic polynucleotide
gacacacacacttagaatctggttttagagctagaaatagcaagttaaaataaggc

SEQ ID NO: 131 - DNA, 56 bp, Artificial Sequence
  Synthetic polynucleotide
gcacacacacttagaatctgtgttttagagctagaaatagcaagttaaaataaggc

SEQ ID NO: 132 - DNA, 55 bp, Artificial Sequence
  Synthetic polynucleotide
gtggggaaggggcccccaaggttttagagctagaaatagcaagttaaaataaggc

SEQ ID NO: 133 - DNA, 56 bp, Artificial Sequence
  Synthetic polynucleotide
gacgtaccaggtggagcacccgttttagagctagaaatagcaagttaaaataaggc

SEQ ID NO: 134 - DNA, 25 bp, Artificial Sequence
  Synthetic polynucleotide
  misc_feature (12)..(12): U is ideoxyU
agttgtacgcguccaaaaaaacggg

SEQ ID NO: 135 - DNA, 22 bp, Artificial Sequence
  Synthetic polynucleotide
agattagcggatcctacctgac

SEQ ID NO: 136 - DNA, 21 bp, Artificial Sequence
  Synthetic polynucleotide
gcggtctgtatttcccagaac

SEQ ID NO: 137 - DNA, 21 bp, Artificial Sequence
  Synthetic polynucleotide
  misc_feature (17)..(17): U is ideoxyU
accggggacttcagaaucggc

SEQ ID NO: 138 - DNA, 23 bp, Artificial Sequence
  Synthetic polynucleotide
  misc_feature (17)..(17): U is ideoxyU
attctgaagtccccggugtttcg

SEQ ID NO: 139 - DNA, 32 bp, Artificial Sequence
  Synthetic polynucleotide
  misc_feature (12)..(12): U is ideoxyU
acgcgtacaacucaaaggaggaaaaaaaaatg

SEQ ID NO: 140 - DNA, 47 bp, Artificial Sequence
  Synthetic polynucleotide
  misc_feature (15)..(15): U is ideoxyU
  misc_feature (25)..(26): n is a, c, g, t or u
  misc_feature (28)..(29): n is a, c, g, t or u
acgctggcgaaacgugcctgggatnnknnkgaagtgccggtcggcgc

SEQ ID NO: 141 - DNA, 27 bp, Artificial Sequence
  Synthetic polynucleotide
  misc_feature (15)..(15): U is ideoxyU
acgtttcgccagcgucagcgcgtgacg

SEQ ID NO: 142 - DNA, 20 bp, Artificial Sequence
  Synthetic polynucleotide
  misc_feature (17)..(17): U is ideoxyU
acgcgaaaactggcgcugcg

SEQ ID NO: 143 - DNA, 42 bp, Artificial Sequence
  Synthetic polynucleotide
  misc_feature (17)..(17): U is ideoxyU
  misc_feature (20)..(21): n is a, c, g, t or u
agcgccagttttcgcgutmnncacaccaaagaccacgcgacc

SEQ ID NO: 144 - DNA, 48 bp, Artificial Sequence
  Synthetic polynucleotide
  misc_feature (14)..(14): U is ideoxyU
  misc_feature (17)..(18): n is a, c, g, t or u
  misc_feature (20)..(21): n is a, c, g, t or u
agtggcggatgagugcnnknnkttgctcagttacttctttcgcatgcg

SEQ ID NO: 145 - DNA, 24 bp, Artificial Sequence
  Synthetic polynucleotide
  misc_feature (14)..(14): U is ideoxyU
actcatccgccaguattccttccg

SEQ ID NO: 146 - DNA, 20 bp, Artificial Sequence
  Synthetic polynucleotide
tacggcgtagtgcacctgga

SEQ ID NO: 147 - DNA, 20 bp, Artificial Sequence
  Synthetic polynucleotide
tacggcgtagtgcacctgga

SEQ ID NO: 148 - DNA, 20 bp, Artificial Sequence
  Synthetic polynucleotide
atcttattcgatcatgcgaa

SEQ ID NO: 149 - DNA, 20 bp, Artificial Sequence
  Synthetic polynucleotide
caatgatgacttctacagcg

SEQ ID NO: 150 - DNA, 20 bp, Artificial Sequence
  Synthetic polynucleotide
caatgatgacttctacagcg

SEQ ID NO: 151 - DNA, 20 bp, Artificial Sequence
  Synthetic polynucleotide
caatgatgacttctacagcg

SEQ ID NO: 152 - DNA, 20 bp, Artificial Sequence
  Synthetic polynucleotide
ttcattaactgtggccggct

SEQ ID NO: 153 - DNA, 20 bp, Artificial Sequence
  Synthetic polynucleotide
gcttaggtggagcgcctatt

SEQ ID NO: 154 - DNA, 20 bp, Artificial Sequence
  Synthetic polynucleotide
tacggcgtagtgcacctgga

SEQ ID NO: 155 - DNA, 20 bp, Artificial Sequence
  Synthetic polynucleotide
tacggcgtagtgcacctgga

SEQ ID NO: 156 - DNA, 20 bp, Artificial Sequence
  Synthetic polynucleotide
atcttattcgatcatgcgaa

SEQ ID NO: 157 - DNA, 20 bp, Artificial Sequence
  Synthetic polynucleotide
tacggcgtagtgcacctgga

SEQ ID NO: 158 - DNA, 20 bp, Artificial Sequence
  Synthetic polynucleotide
tacggcgtagtgcacctgga

SEQ ID NO: 159 - DNA, 20 bp, Artificial Sequence
  Synthetic polynucleotide
atcttattggagcgcctatt

SEQ ID NO: 160 - DNA, 20 bp, Artificial Sequence
  Synthetic polynucleotide
gcttaggtggagcgcctatt

SEQ ID NO: 161 - DNA, 20 bp, Artificial Sequence
  Synthetic polynucleotide
caatgatgacttctacagcg

SEQ ID NO: 162 - DNA, 20 bp, Artificial Sequence
  Synthetic polynucleotide
tacggcgtagtgcacctgga

SEQ ID NO: 163 - DNA, 20 bp, Artificial Sequence
  Synthetic polynucleotide
caatgatgacttctacagcg

SEQ ID NO: 164 - DNA, 20 bp, Artificial Sequence
  Synthetic polynucleotide
tacggcgtagtgcacctgga

SEQ ID NO: 165 - DNA, 20 bp, Artificial Sequence
  Synthetic polynucleotide
caatgatgacttctacagcg

SEQ ID NO: 166 - DNA, 20 bp, Artificial Sequence
  Synthetic polynucleotide
tacggcgtagtgcacctgga

SEQ ID NO: 167 - DNA, 20 bp, Artificial Sequence
  Synthetic polynucleotide
atcttattcgatcatgcgaa

SEQ ID NO: 168 - DNA, 20 bp, Artificial Sequence
  Synthetic polynucleotide
ttcattaactgtggccggct

SEQ ID NO: 169 - DNA, 57 bp, Artificial Sequence
  Synthetic polynucleotide
  misc_feature (34)..(37): n is a, c, g, or t
acactctttccctacacgacgctcttccgatctnnnnccagccccatctgtcaaact

SEQ ID NO: 170 - DNA, 54 bp, Artificial Sequence
  Synthetic polynucleotide
tggagttcagacgtgtgctcttccgatcttgaatggattccttggaaacaatga

SEQ ID NO: 171 - DNA, 57 bp, Artificial Sequence
  Synthetic polynucleotide
  misc_feature (34)..(37): n is a, c, g, or t
acactctttccctacacgacgctcttccgatctnnnnagagactgattgcgtggagt

SEQ ID NO: 172 - DNA, 49 bp, Artificial Sequence
  Synthetic polynucleotide
tggagttcagacgtgtgctcttccgatctcactccagcctaggcaacaa

SEQ ID NO: 173 - DNA, 57 bp, Artificial Sequence
  Synthetic polynucleotide
  misc_feature (34)..(37): n is a, c, g, or t
acactctttccctacacgacgctcttccgatctnnnnccgacagccagtggttaagt

SEQ ID NO: 174 - DNA, 49 bp, Artificial Sequence
  Synthetic polynucleotide
tggagttcagacgtgtgctcttccgatctgcttttcaccgactgcacag

SEQ ID NO: 175 - DNA, 57 bp, Artificial Sequence
  Synthetic polynucleotide
  misc_feature (34)..(37): n is a, c, g, or t
acactctttccctacacgacgctcttccgatctnnnnctgcacctagcctccatgtc

SEQ ID NO: 176 - DNA, 49 bp, Artificial Sequence
  Synthetic polynucleotide
tggagttcagacgtgtgctcttccgatctccttgcactgagaccgtgaa

SEQ ID NO: 177 - DNA, 57 bp, Artificial Sequence
  Synthetic polynucleotide
  misc_feature (34)..(37): n is a, c, g, or t
acactctttccctacacgacgctcttccgatctnnnngtctgaggtcacacagtggg

SEQ ID NO: 178 - DNA, 49 bp, Artificial Sequence
  Synthetic polynucleotide
tggagttcagacgtgtgctcttccgatctctgagagcagggaccacatc

SEQ ID NO: 179 - DNA, 57 bp, Artificial Sequence
  Synthetic polynucleotide
  misc_feature (34)..(37): n is a, c, g, or t
acactctttccctacacgacgctcttccgatctnnnnatgtgggctgcctagaaagg

SEQ ID NO: 180 - DNA, 49 bp, Artificial Sequence
  Synthetic polynucleotide
tggagttcagacgtgtgctcttccgatctcccagccaaacttgtcaacc

SEQ ID NO: 181 - DNA, 57 bp, Artificial Sequence
  Synthetic polynucleotide
  misc_feature (34)..(37): n is a, c, g, or t
acactctttccctacacgacgctcttccgatctnnnngatgccctccatcttctccg

SEQ ID NO: 182 - DNA, 49 bp, Artificial Sequence
  Synthetic polynucleotide
tggagttcagacgtgtgctcttccgatctaggtttgcatagacctgccc

SEQ ID NO: 183 - DNA, 57 bp, Artificial Sequence
  Synthetic polynucleotide
  misc_feature (34)..(37): n is a, c, g, or t
acactctttccctacacgacgctcttccgatctnnnnccctgttcctaaagcccacc

SEQ ID NO: 184 - DNA, 49 bp, Artificial Sequence
  Synthetic polynucleotide
tggagttcagacgtgtgctcttccgatctactggttctgtttgtggcca

SEQ ID NO: 185 - DNA, 57 bp, Artificial Sequence
  Synthetic polynucleotide
  misc_feature (34)..(37): n is a, c, g, or t
acactctttccctacacgacgctcttccgatctnnnnttgcttattgctgaggggca

SEQ ID NO: 186 - DNA, 49 bp, Artificial Sequence
  Synthetic polynucleotide
tggagttcagacgtgtgctcttccgatctacctctctcctccagctgag

SEQ ID NO: 187 - DNA, 57 bp, Artificial Sequence
  Synthetic polynucleotide
  misc_feature (34)..(37): n is a, c, g, or t
acactctttccctacacgacgctcttccgatctnnnntccacctccccacttctctt

SEQ ID NO: 188 - DNA, 49 bp, Artificial Sequence
  Synthetic polynucleotide
tggagttcagacgtgtgctcttccgatctggtgaaatgagcaaggcaca

SEQ ID NO: 189 - DNA, 57 bp, Artificial Sequence
  Synthetic polynucleotide
  misc_feature (34)..(37): n is a, c, g, or t
acactctttccctacacgacgctcttccgatctnnnnccctaaaccacctgcagagg

SEQ ID NO: 190 - DNA, 49 bp, Artificial Sequence
  Synthetic polynucleotide
tggagttcagacgtgtgctcttccgatctcagccccagccacattctat

SEQ ID NO: 191 - DNA, 57 bp, Artificial Sequence
  Synthetic polynucleotide
  misc_feature (34)..(37): n is a, c, g, or t
acactctttccctacacgacgctcttccgatctnnnnacccatgtgcctgacatagg

SEQ ID NO: 192 - DNA, 51 bp, Artificial Sequence
  Synthetic polynucleotide
tggagttcagacgtgtgctcttccgatcttggtgattatggttacacagcg

SEQ ID NO: 193 - DNA, 57 bp, Artificial Sequence
  Synthetic polynucleotide
  misc_feature (34)..(37): n is a, c, g, or t
acactctttccctacacgacgctcttccgatctnnnntcacttcagcccaggagtat

SEQ ID NO: 194 - DNA, 49 bp, Artificial Sequence
  Synthetic polynucleotide
tggagttcagacgtgtgctcttccgatcttctctttctctcccccaccc

SEQ ID NO: 195 - DNA, 57 bp, Artificial Sequence
  Synthetic polynucleotide
  misc_feature (34)..(37): n is a, c, g, or t
acactctttccctacacgacgctcttccgatctnnnngaacctgaagcctttcccca

SEQ ID NO: 196 - DNA, 49 bp, Artificial Sequence
  Synthetic polynucleotide
tggagttcagacgtgtgctcttccgatctaacctgtgtgacacttggca

SEQ ID NO: 197 - DNA, 57 bp, Artificial Sequence
  Synthetic polynucleotide
  misc_feature (34)..(37): n is a, c, g, or t
acactctttccctacacgacgctcttccgatctnnnngcagacacccacaactgtct

SEQ ID NO: 198 - DNA, 52 bp, Artificial Sequence
  Synthetic polynucleotide
tggagttcagacgtgtgctcttccgatctgcactcagctagacttaactccc

SEQ ID NO: 199 - DNA, 57 bp, Artificial Sequence
  Synthetic polynucleotide
  misc_feature (34)..(37): n is a, c, g, or t
acactctttccctacacgacgctcttccgatctnnnngggaggtggagagaggatgt

SEQ ID NO: 200 - DNA, 49 bp, Artificial Sequence
  Synthetic polynucleotide
tggagttcagacgtgtgctcttccgatcttcctgaggtctaggaacccg

SEQ ID NO: 201 - DNA, 57 bp, Artificial Sequence
  Synthetic polynucleotide
  misc_feature (34)..(37): n is a, c, g, or t
acactctttccctacacgacgctcttccgatctnnnncgcgggctgaagtagatcaa

SEQ ID NO: 202 - DNA, 52 bp, Artificial Sequence
  Synthetic polynucleotide
tggagttcagacgtgtgctcttccgatctcctgtctctgctcctttgtcccc

SEQ ID NO: 203 - DNA, 57 bp, Artificial Sequence
  Synthetic polynucleotide
  misc_feature (34)..(37): n is a, c, g, or t
acactctttccctacacgacgctcttccgatctnnnngcattacctgggagcctgtt

SEQ ID NO: 204 - DNA, 49 bp, Artificial Sequence
  Synthetic polynucleotide
tggagttcagacgtgtgctcttccgatctaacttcagcgggcatcagaa

SEQ ID NO: 205 - DNA, 57 bp, Artificial Sequence
  Synthetic polynucleotide
  misc_feature (34)..(37): n is a, c, g, or t
acactctttccctacacgacgctcttccgatctnnnngtggagtttagccagggacc

SEQ ID NO: 206 - DNA, 49 bp, Artificial Sequence
  Synthetic polynucleotide
tggagttcagacgtgtgctcttccgatcttacaggcctcactggagcta

SEQ ID NO: 207 - DNA, 57 bp, Artificial Sequence
  Synthetic polynucleotide
  misc_feature (34)..(37): n is a, c, g, or t
acactctttccctacacgacgctcttccgatctnnnnggctggataaccttggctgt

SEQ ID NO: 208 - DNA, 49 bp, Artificial Sequence
  Synthetic polynucleotide
tggagttcagacgtgtgctcttccgatcttcctcaggcactcctctcaa

SEQ ID NO: 209 - DNA, 57 bp, Artificial Sequence; identical to SEQ ID NO: 169
  Synthetic polynucleotide
  misc_feature (34)..(37): n is a, c, g, or t

SEQ ID NO: 210 - DNA, 54 bp, Artificial Sequence; identical to SEQ ID NO: 170
  Synthetic polynucleotide

SEQ ID NO: 211 - DNA, 57 bp, Artificial Sequence; identical to SEQ ID NO: 179
  Synthetic polynucleotide
  misc_feature (34)..(37): n is a, c, g, or t

SEQ ID NO: 212 - DNA, 49 bp, Artificial Sequence; identical to SEQ ID NO: 180
  Synthetic polynucleotide

SEQ ID NO: 213 - DNA, 57 bp, Artificial Sequence
  Synthetic polynucleotide
  misc_feature (34)..(37): n is a, c, g, or t
acactctttccctacacgacgctcttccgatctnnnngaacccaggtagccagagac

SEQ ID NO: 214 - DNA, 49 bp, Artificial Sequence
  Synthetic polynucleotide
tggagttcagacgtgtgctcttccgatcttcctttcaacccgaacggag

SEQ ID NO: 215 - DNA, 58 bp, Artificial Sequence
  Synthetic polynucleotide
  misc_feature (34)..(37): n is a, c, g, or t
acactctttccctacacgacgctcttccgatctnnnngtgtggagagtgagtaagcca

SEQ ID NO: 216 - DNA, 50 bp, Artificial Sequence
  Synthetic polynucleotide
tggagttcagacgtgtgctcttccgatctacggtaggatgatttcaggca

SEQ ID NO: 217 - DNA, 58 bp, Artificial Sequence
  Synthetic polynucleotide
  misc_feature (34)..(37): n is a, c, g, or t
acactctttccctacacgacgctcttccgatctnnnncacaaagcagtgtagctcagg

SEQ ID NO: 218 - DNA, 54 bp, Artificial Sequence
  Synthetic polynucleotide
tggagttcagacgtgtgctcttccgatcttttttggtactcgagtgttattcag

SEQ ID NO: 219 - DNA, 57 bp, Artificial Sequence
  Synthetic polynucleotide
  misc_feature (34)..(37): n is a, c, g, or t
acactctttccctacacgacgctcttccgatctnnnntcccctgttgacctggagaa

SEQ ID NO: 220 - DNA, 49 bp, Artificial Sequence
  Synthetic polynucleotide
tggagttcagacgtgtgctcttccgatctcactgtacttgccctgacca

SEQ ID NO: 221 - DNA, 57 bp, Artificial Sequence
  Synthetic polynucleotide
  misc_feature (34)..(37): n is a, c, g, or t
acactctttccctacacgacgctcttccgatctnnnnttggtgttgacagggagcaa

SEQ ID NO: 222 - DNA, 49 bp, Artificial Sequence
  Synthetic polynucleotide
tggagttcagacgtgtgctcttccgatctctgagatgtgggcagaaggg

SEQ ID NO: 223 - DNA, 57 bp, Artificial Sequence
  Synthetic polynucleotide
  misc_feature (34)..(37): n is a, c, g, or t
acactctttccctacacgacgctcttccgatctnnnntgagagggaacagaagggct

SEQ ID NO: 224 - DNA, 49 bp, Artificial Sequence
  Synthetic polynucleotide
tggagttcagacgtgtgctcttccgatctgtccaaaggcccaagaacct

SEQ ID NO: 225 - DNA, 58 bp, Artificial Sequence
  Synthetic polynucleotide
  misc_feature (34)..(37): n is a, c, g, or t
acactctttccctacacgacgctcttccgatctnnnntcctagcactttggaaggtcg

SEQ ID NO: 226 - DNA, 51 bp, Artificial Sequence
  Synthetic polynucleotide
tggagttcagacgtgtgctcttccgatctgctcatcttaatctgctcagcc

SEQ ID NO: 227 - DNA, 57 bp, Artificial Sequence
  Synthetic polynucleotide
  misc_feature (34)..(37): n is a, c, g, or t
acactctttccctacacgacgctcttccgatctnnnnaaaggagcagctcttcctgg

SEQ ID NO: 228 - DNA, 49 bp, Artificial Sequence
  Synthetic polynucleotide
tggagttcagacgtgtgctcttccgatctgtctgcaccatctcccacaa

SEQ ID NO: 229 - DNA, 57 bp, Artificial Sequence
  Synthetic polynucleotide
  misc_feature (34)..(37): n is a, c, g, or t
acactctttccctacacgacgctcttccgatctnnnnggcatggcttctgagactca

SEQ ID NO: 230 - DNA, 53 bp, Artificial Sequence
  Synthetic polynucleotide
tggagttcagacgtgtgctcttccgatctgtctcccttgcactccctgtcttt

SEQ ID NO: 231 - DNA, 57 bp, Artificial Sequence
  Synthetic polynucleotide
  misc_feature (34)..(37): n is a, c, g, or t
acactctttccctacacgacgctcttccgatctnnnntttggcaatggaggcattgg

SEQ ID NO: 232 - DNA, 49 bp, Artificial Sequence
  Synthetic polynucleotide
tggagttcagacgtgtgctcttccgatctgaagaggctgcccatgagag

SEQ ID NO: 233 - DNA, 57 bp, Artificial Sequence
  Synthetic polynucleotide
  misc_feature (34)..(37): n is a, c, g, or t
acactctttccctacacgacgctcttccgatctnnnnggtctgaggctcgaatcctg

SEQ ID NO: 234 - DNA, 49 bp, Artificial Sequence
  Synthetic polynucleotide
tggagttcagacgtgtgctcttccgatctctgtggcctccatatccctg

SEQ ID NO: 235 - DNA, 57 bp, Artificial Sequence
  Synthetic polynucleotide
  misc_feature (34)..(37): n is a, c, g, or t
acactctttccctacacgacgctcttccgatctnnnntttccaccagaactcagccc

SEQ ID NO: 236 - DNA, 49 bp, Artificial Sequence
  Synthetic polynucleotide
tggagttcagacgtgtgctcttccgatctcctcggttcctccacaacac

SEQ ID NO: 237 - DNA, 57 bp, Artificial Sequence
  Synthetic polynucleotide
  misc_feature (34)..(37): n is a, c, g, or t
acactctttccctacacgacgctcttccgatctnnnncacgggaaggacaggagaag

SEQ ID NO: 238 - DNA, 49 bp, Artificial Sequence
  Synthetic polynucleotide
tggagttcagacgtgtgctcttccgatctgcaggggagggataaagcag

SEQ ID NO: 239 - DNA, 57 bp, Artificial Sequence; identical to SEQ ID NO: 169
  Synthetic polynucleotide
  misc_feature (34)..(37): n is a, c, g, or t

SEQ ID NO: 240 - DNA, 54 bp, Artificial Sequence; identical to SEQ ID NO: 170
  Synthetic polynucleotide

SEQ ID NO: 241 - DNA, 59 bp, Artificial Sequence
  Synthetic polynucleotide
  misc_feature (34)..(37): n is a, c, g, or t
acactctttccctacacgacgctcttccgatctnnnnccctgagatacagtcacgaggt

SEQ ID NO: 242 - DNA, 51 bp, Artificial Sequence
  Synthetic polynucleotide
tggagttcagacgtgtgctcttccgatctcctgaaatgctgtgcgtgtcta

SEQ ID NO: 243 - DNA, 59 bp, Artificial Sequence
  Synthetic polynucleotide
  misc_feature (34)..(37): n is a, c, g, or t
acactctttccctacacgacgctcttccgatctnnnngcccacattaccttggtgcata

SEQ ID NO: 244 - DNA, 51 bp, Artificial Sequence
  Synthetic polynucleotide
tggagttcagacgtgtgctcttccgatctggcaggcagattatcattccca

SEQ ID NO: 245 - DNA, 57 bp, Artificial Sequence
  Synthetic polynucleotide
  misc_feature (34)..(37): n is a, c, g, or t
acactctttccctacacgacgctcttccgatctnnnnaaagtgctgcgattacaggc

SEQ ID NO: 246 - DNA, 49 bp, Artificial Sequence
  Synthetic polynucleotide
tggagttcagacgtgtgctcttccgatctgtggcatccagagacatggt

SEQ ID NO: 247 - DNA, 57 bp, Artificial Sequence; identical to SEQ ID NO: 179
  Synthetic polynucleotide
  misc_feature (34)..(37): n is a, c, g, or t

SEQ ID NO: 248 - DNA, 49 bp, Artificial Sequence; identical to SEQ ID NO: 180
  Synthetic polynucleotide

SEQ ID NO: 249 - DNA, 100 bp, Artificial Sequence
  Synthetic polynucleotide
ttttccagcccgctggccctgtaaaggaaactggaacgcaaagcatagactgcgcggcgggccagcctgaatagctgcaaacaagtgcagaatatctgat

SEQ ID NO: 250 - DNA, 99 bp, Artificial Sequence
  Synthetic polynucleotide
catgaaaaagagactgattgcgtggagttcatggagtgtgaggcatagactgcacgagacataaaccatgacttgcagatgaagaagcattttaaaagt

SEQ ID NO: 251 - DNA, 100 bp, Artificial Sequence
  Synthetic polynucleotide
gacagccagtggttaagtcagaacccgactcaggtcaggaaagcagagactgcccggggttgggaaggcggtgaactcagagatagaaacagggtgggtg

SEQ ID NO: 252 - DNA, 100 bp, Artificial Sequence
  Synthetic polynucleotide
attttaagctgtagtattatgaagggaaatctggagcgaagagaatagactgtacggaaaccagttaagaaataggacatggaggctaggtgcagtggct

SEQ ID NO: 253 - DNA, 100 bp, Artificial Sequence
  Synthetic polynucleotide
cctctgccatcacgtgctcagtctgggccccaaggattggcccaggccagggctcgagaagcagaaaaaaagcatcaagcctacaaatgcatgcttactt

SEQ ID NO: 254 - RNA, 28 nt, Artificial Sequence
  Synthetic polynucleotide
gacagauauuugcauugagauagugugg

SEQ ID NO: 255 - RNA, 27 nt, Artificial Sequence
  Synthetic polynucleotide
acagauauuugcauugagauagugugg

SEQ ID NO: 256 - RNA, 26 nt, Artificial Sequence
  Synthetic polynucleotide
cagauauuugcauugagauagugugg

SEQ ID NO: 257 - RNA, 25 nt, Artificial Sequence
  Synthetic polynucleotide
agauauuugcauugagauagugugg

SEQ ID NO: 258 - RNA, 24 nt, Artificial Sequence
  Synthetic polynucleotide
gauauuugcauugagauagugugg

SEQ ID NO: 259 - RNA, 23 nt, Artificial Sequence
  Synthetic polynucleotide
auauuugcauugagauagugugg

SEQ ID NO: 260 - RNA, 23 nt, Artificial Sequence
  Synthetic polynucleotide
augcaaauaucugucugaaacgg

SEQ ID NO: 261 - RNA, 28 nt, Artificial Sequence
  Synthetic polynucleotide
gcaaauaucugucugaaacggucccugg

SEQ ID NO: 262 - RNA, 27 nt, Artificial Sequence
  Synthetic polynucleotide
caaauaucugucugaaacggucccugg

SEQ ID NO: 263 - RNA, 26 nt, Artificial Sequence
  Synthetic polynucleotide
aaauaucugucugaaacggucccugg

SEQ ID NO: 264 - RNA, 25 nt, Artificial Sequence
  Synthetic polynucleotide
aauaucugucugaaacggucccugg

SEQ ID NO: 265 - RNA, 24 nt, Artificial Sequence
  Synthetic polynucleotide
auaucugucugaaacggucccugg

SEQ ID NO: 266 - RNA, 23 nt, Artificial Sequence
  Synthetic polynucleotide
uaucugucugaaacggucccugg

SEQ ID NO: 267 - RNA, 23 nt, Artificial Sequence
  Synthetic polynucleotide
agauauuugcauugagauagugu

SEQ ID NO: 268 - RNA, 23 nt, Artificial Sequence
  Synthetic polynucleotide
acagauauuugcauugagauagu

SEQ ID NO: 269 - RNA, 23 nt, Artificial Sequence
  Synthetic polynucleotide
guggggaaggggcccccaagagg

SEQ ID NO: 270 - RNA, 23 nt, Artificial Sequence
  Synthetic polynucleotide
cuugaccaauagccuugacaagg

SEQ ID NO: 271 - RNA, 28 nt, Artificial Sequence
  Synthetic polynucleotide
cuugucaaggcuauuggucaaggcaagg

SEQ ID NO: 272 - RNA, 27 nt, Artificial Sequence
  Synthetic polynucleotide
uugucaaggcuauuggucaaggcaagg

SEQ ID NO: 273 - RNA, 26 nt, Artificial Sequence
  Synthetic polynucleotide
ugucaaggcuauuggucaaggcaagg

SEQ ID NO: 274 - RNA, 25 nt, Artificial Sequence
  Synthetic polynucleotide
gucaaggcuauuggucaaggcaagg

SEQ ID NO: 275 - RNA, 24 nt, Artificial Sequence
  Synthetic polynucleotide
ucaaggcuauuggucaaggcaagg

SEQ ID NO: 276 - RNA, 23 nt, Artificial Sequence
  Synthetic polynucleotide
caaggcuauuggucaaggcaagg

SEQ ID NO: 277 - RNA, 23 nt, Artificial Sequence
  Synthetic polynucleotide
uugucaaggcuauuggucaaggc

SEQ ID NO: 278 - RNA, 23 nt, Artificial Sequence
  Synthetic polynucleotide
cuugucaaggcuauuggucaagg

SEQ ID NO: 279 - RNA, 23 nt, Artificial Sequence
  Synthetic polynucleotide
uugaccaauagccuugacaaggc

SEQ ID NO: 280 - RNA, 23 nt, Artificial Sequence
  Synthetic polynucleotide
uagccuugacaaggcaaacuuga

SEQ ID NO: 281 - RNA, 23 nt, Artificial Sequence
  Synthetic polynucleotide
uucuccacaggagucagaugcac

SEQ ID NO: 282 - RNA, 23 nt, Artificial Sequence
  Synthetic polynucleotide
ucuccacaggagucagaugcacc

SEQ ID NO: 283 - RNA, 28 nt, Artificial Sequence
  Synthetic polynucleotide
uucuccacaggagucagaugcaccaugg

SEQ ID NO: 284 - RNA, 27 nt, Artificial Sequence
  Synthetic polynucleotide
ucuccacaggagucagaugcaccaugg

SEQ ID NO: 285 - RNA, 26 nt, Artificial Sequence
  Synthetic polynucleotide
cuccacaggagucagaugcaccaugg

SEQ ID NO: 286 - RNA, 25 nt, Artificial Sequence
  Synthetic polynucleotide
uccacaggagucagaugcaccaugg

SEQ ID NO: 287 - RNA, 24 nt, Artificial Sequence
  Synthetic polynucleotide
ccacaggagucagaugcaccaugg

SEQ ID NO: 288 - RNA, 23 nt, Artificial Sequence
  Synthetic polynucleotide
cacaggagucagaugcaccaugg

SEQ ID NO: 289 - RNA, 23 nt, Artificial Sequence
  Synthetic polynucleotide
acuucuccacaggagucagaugc

SEQ ID NO: 290 - RNA, 28 nt, Artificial Sequence
  Synthetic polynucleotide
ucuccacaggagucagaugcaccauggu

SEQ ID NO: 291 - RNA, 23 nt, Artificial Sequence
  Synthetic polynucleotide
acuccuaaggagaagucugccgu

SEQ ID NO: 292 - RNA, 23 nt, Artificial Sequence
  Synthetic polynucleotide
uuggugguaaggcccugggcagg

SEQ ID NO: 293 - RNA, 23 nt, Artificial Sequence
  Synthetic polynucleotide
uggugguaaggcccugggcaggu

SEQ ID NO: 294 - RNA, 23 nt, Artificial Sequence
  Synthetic polynucleotide
ugguaaggcccugggcagguugg

SEQ ID NO: 295 - RNA, 23 nt, Artificial Sequence
  Synthetic polynucleotide
agcauuguauauucucugugagg

SEQ ID NO: 296 - RNA, 23 nt, Artificial Sequence
  Synthetic polynucleotide
aaagcauuguauauucucuguga

SEQ ID NO: 297 - DNA, 28 bp, Artificial Sequence
  Synthetic polynucleotide
ccacactatctcaatgcaaatatctgtc

SEQ ID NO: 298 - DNA, 27 bp, Artificial Sequence
  Synthetic polynucleotide
ccacactatctcaatgcaaatatctgt

SEQ ID NO: 299 - DNA, 26 bp, Artificial Sequence
  Synthetic polynucleotide
ccacactatctcaatgcaaatatctg

SEQ ID NO: 300 - DNA, 25 bp, Artificial Sequence
  Synthetic polynucleotide
ccacactatctcaatgcaaatatct

SEQ ID NO: 301 - DNA, 24 bp, Artificial Sequence
  Synthetic polynucleotide
ccacactatctcaatgcaaatatc

SEQ ID NO: 302 - DNA, 23 bp, Artificial Sequence
  Synthetic polynucleotide
ccacactatctcaatgcaaatat

SEQ ID NO: 303 - DNA, 23 bp, Artificial Sequence
  Synthetic polynucleotide
ccgtttcagacagatatttgcat

SEQ ID NO: 304 - DNA, 28 bp, Artificial Sequence
  Synthetic polynucleotide
ccagggaccgtttcagacagatatttgc

SEQ ID NO: 305 - DNA, 27 bp, Artificial Sequence
  Synthetic polynucleotide
ccagggaccgtttcagacagatatttg

SEQ ID NO: 306 - DNA, 26 bp, Artificial Sequence
  Synthetic polynucleotide
ccagggaccgtttcagacagatattt

SEQ ID NO: 307 - DNA, 25 bp, Artificial Sequence
  Synthetic polynucleotide
ccagggaccgtttcagacagatatt

SEQ ID NO: 308 - DNA, 24 bp, Artificial Sequence
  Synthetic polynucleotide
ccagggaccgtttcagacagatat

SEQ ID NO: 309 - DNA, 23 bp, Artificial Sequence
  Synthetic polynucleotide
ccagggaccgtttcagacagata

SEQ ID NO: 310 - DNA, 23 bp, Artificial Sequence
  Synthetic polynucleotide
acactatctcaatgcaaatatct

SEQ ID NO: 311 - DNA, 23 bp, Artificial Sequence
  Synthetic polynucleotide
actatctcaatgcaaatatctgt

SEQ ID NO: 312 - DNA, 23 bp, Artificial Sequence
  Synthetic polynucleotide
cctcttgggggccccttccccac

SEQ ID NO: 313 - DNA, 23 bp, Artificial Sequence
  Synthetic polynucleotide
ccttgtcaaggctattggtcaag

SEQ ID NO: 314 - DNA, 28 bp, Artificial Sequence
  Synthetic polynucleotide
ccttgccttgaccaatagccttgacaag

SEQ ID NO: 315 - DNA, 27 bp, Artificial Sequence
  Synthetic polynucleotide
ccttgccttgaccaatagccttgacaa

SEQ ID NO: 316 - DNA, 26 bp, Artificial Sequence
  Synthetic polynucleotide
ccttgccttgaccaatagccttgaca

SEQ ID NO: 317 - DNA, 25 bp, Artificial Sequence
  Synthetic polynucleotide
ccttgccttgaccaatagccttgac

SEQ ID NO: 318 - DNA, 24 bp, Artificial Sequence
  Synthetic polynucleotide
ccttgccttgaccaatagccttga

SEQ ID NO: 319 - DNA, 23 bp, Artificial Sequence
  Synthetic polynucleotide
ccttgccttgaccaatagccttg

SEQ ID NO: 320 - DNA, 23 bp, Artificial Sequence
  Synthetic polynucleotide
gccttgaccaatagccttgacaa

SEQ ID NO: 321 - DNA, 23 bp, Artificial Sequence
  Synthetic polynucleotide
ccttgaccaatagccttgacaag

SEQ ID NO: 322 - DNA, 23 bp, Artificial Sequence
  Synthetic polynucleotide
gccttgtcaaggctattggtcaa

SEQ ID NO: 323 - DNA, 23 bp, Artificial Sequence
  Synthetic polynucleotide
tcaagtttgccttgtcaaggcta

SEQ ID NO: 324 - DNA, 23 bp, Artificial Sequence
  Synthetic polynucleotide
gtgcatctgactcctgtggagaa

SEQ ID NO: 325 - DNA, 23 bp, Artificial Sequence
  Synthetic polynucleotide
ggtgcatctgactcctgtggaga

SEQ ID NO: 326 - DNA, 28 bp, Artificial Sequence
  Synthetic polynucleotide
ccatggtgcatctgactcctgtggagaa

SEQ ID NO: 327 - DNA, 27 bp, Artificial Sequence
  Synthetic polynucleotide
ccatggtgcatctgactcctgtggaga

SEQ ID NO: 328 - DNA, 26 bp, Artificial Sequence
  Synthetic polynucleotide
ccatggtgcatctgactcctgtggag

SEQ ID NO: 329 - DNA, 25 bp, Artificial Sequence
  Synthetic polynucleotide
ccatggtgcatctgactcctgtgga

SEQ ID NO: 330 - DNA, 24 bp, Artificial Sequence
  Synthetic polynucleotide
ccatggtgcatctgactcctgtgg

SEQ ID NO: 331 - DNA, 23 bp, Artificial Sequence
  Synthetic polynucleotide
ccatggtgcatctgactcctgtg

SEQ ID NO: 332 - DNA, 23 bp, Artificial Sequence
  Synthetic polynucleotide
gcatctgactcctgtggagaagt

SEQ ID NO: 333 - DNA, 28 bp, Artificial Sequence
  Synthetic polynucleotide
accatggtgcatctgactcctgtggaga

SEQ ID NO: 334 - DNA, 23 bp, Artificial Sequence
  Synthetic polynucleotide
acggcagacttctccttaggagt

SEQ ID NO: 335 - DNA, 23 bp, Artificial Sequence
  Synthetic polynucleotide
cctgcccagggccttaccaccaa

SEQ ID NO: 336 - DNA, 23 bp, Artificial Sequence
  Synthetic polynucleotide
acctgcccagggccttaccacca

SEQ ID NO: 337 - DNA, 23 bp, Artificial Sequence
  Synthetic polynucleotide
ccaacctgcccagggccttacca

SEQ ID NO: 338 - DNA, 23 bp, Artificial Sequence
  Synthetic polynucleotide
cctcacagagaatatacaatgct

SEQ ID NO: 339 - DNA, 23 bp, Artificial Sequence
  Synthetic polynucleotide
tcacagagaatatacaatgcttt

SEQ ID NO: 340 - protein, 146 aa, Artificial Sequence
  Synthetic polypeptide
VHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 341 - protein, 2351 aa, Artificial Sequence
  Synthetic polypeptide
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 342 - protein, 18 aa, Artificial Sequence
  Synthetic polypeptide
MKRTADGSEFEPKKKRKV

SEQ ID NO: 343 - protein, 17 aa, Artificial Sequence
  Synthetic polypeptide
KRTADGSEFEPKKKRKV

SEQ ID NO: 344 - DNA, 343 bp, Artificial Sequence
  Synthetic polynucleotide
ctgacaaaagaagtcctggtatcctctatgatgggagaaggaaactagctaaagggaagaataaattagagaaaaactggaatgactgaatcggaacaaggcaaaggctataaaaaaaattagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccac

SEQ ID NO: 345 - DNA, 318 bp, Artificial Sequence
  Synthetic polynucleotide
ggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccac

SEQ ID NO: 346 - DNA, 1606 bp, Artificial Sequence
  Synthetic polynucleotide
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgc

SEQ ID NO: 347 - DNA, 9036 bp, Artificial Sequence
  Synthetic polynucleotide
gcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaa

SEQ ID NO: 348-370 - skipped (23 entries)

SEQ ID NO: 371 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 372 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 373 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 374 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 375 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 376-383 - skipped (8 entries)

SEQ ID NO: 384 - protein, 24 aa, Artificial Sequence
  Synthetic polypeptide
SGGSSGSETPGTSESATPESSGGS

SEQ ID NO: 385 - protein, 32 aa, Artificial Sequence
  Synthetic polypeptide
SGGSSGGSSGSETPGTSESATPESSGGSSGGS

SEQ ID NO: 386 - protein, 104 aa, Artificial Sequence
  Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 387-388 - skipped (2 entries)

SEQ ID NO: 389 - RNA, 82 nt, Artificial Sequence
  Synthetic polynucleotide
guuuuagagcuagaaauagcaaguuaaaauaaaggcuaguccguuaucaacuugaaaaaguggcaccgagucggugcuuuuu

SEQ ID NO: 390-416 - skipped (27 entries)

SEQ ID NO: 417 - protein, 345 aa, Artificial Sequence
  Synthetic polypeptide
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 418 - protein, 345 aa, Artificial Sequence
  Synthetic polypeptide
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 419 - protein, 1210 aa, Artificial Sequence
  Synthetic polypeptide
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 420 - protein, 166 aa, Artificial Sequence
  Synthetic polypeptide
SEVEFSHEYWMRHALTLAKRAWDAGEVPVGAVLVHNNRVIGEGWNRPIGRHDPTAHAEIMALRQGGLVMQNYRLIDATLYVTFEPCVMCAGAMIHSRIGRVVFGVNNAKTGAAGSLMDVLHYPGMNHRVEITEGILADECNELLSYFFRMRRQVFKAQKKAQSSTD

SEQ ID NO: 421 - protein, 166 aa, Artificial Sequence; identical to SEQ ID NO: 73
  Synthetic polypeptide

SEQ ID NO: 422 - protein, 166 aa, Artificial Sequence
  Synthetic polypeptide
SEVEFSHEYWMRHALTLAKRAWDEREVPVGAVLVHTNRVIGEGWNRTIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 423 - protein, 166 aa, Artificial Sequence
  Synthetic polypeptide
SEVEFSHEYWMRHALTLAKRAWDEREVPVGAVLVHSNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 424 - protein, 166 aa, Artificial Sequence
  Synthetic polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 425 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLRYFFRMRRQVFKAQKKAQSSTD

SEQ ID NO: 426 - protein, 166 aa, Artificial Sequence
  Synthetic polypeptide
SEVEFSHEYWMRHALTLAKRAWDEREVPVGAVLVLNNRVIGEGWNRLIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 427 - protein, 166 aa, Artificial Sequence
  Synthetic polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 428 - protein, 166 aa, Artificial Sequence
  Synthetic polypeptide
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFKAQKKAQSSTD

SEQ ID NO: 429 - protein, 166 aa, Artificial Sequence; identical to SEQ ID NO: 425
  Synthetic polypeptide

SEQ ID NO: 430 - protein, 166 aa, Artificial Sequence
  Synthetic polypeptide
SEVEFSHEYWMRHALTLAKRAWDEREVPVGAVLVHSNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 431 - protein, 166 aa, Artificial Sequence
  Synthetic polypeptide
SEVEFSHEYWMRHALTLAKRAWDEREVPVGAVLVHNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 432 - protein, 166 aa, Artificial Sequence
  Synthetic polypeptide
SEVEFSHEYWMRHALTLAKRAWDEREVPVGAVLVHNNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 433-671 - skipped (239 entries)

SEQ ID NO: 672 - protein, 166 aa, Artificial Sequence
  Synthetic polypeptide
SEVEFSHEYWMRHALTLAKRAWDEREVPVGAVLVHNNRVIGEGWNRSIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 673 - protein, 166 aa, Artificial Sequence
  Synthetic polypeptide
SEVEFSHEYWMRHALTLAKRAWDEREVPVGAVLVHNNRVIGEGWNRTIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 674 - protein, 166 aa, Artificial Sequence
  Synthetic polypeptide
SEVEFSHEYWMRHALTLAKRAWDEREVPVGAVLVHNNRVIGEGWNRAIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 675 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECNALLSDFFRMRRQEIKAQKKAQSSTD

SEQ ID NO: 676 - protein, 166 aa, Artificial Sequence
  Synthetic polypeptide
SEVEFSHEYWMRHALTLAKRARDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 677 - protein, 166 aa, Artificial Sequence
  Synthetic polypeptide
SEVEFSHEYWMRHALTLAKRALDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 678 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMPRQEIKAQKKAQSSTD

SEQ ID NO: 679 - protein, 166 aa, Artificial Sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMHRQEIKAQKKAQSSTD

SEQ ID NO: 680 - protein, 166 aa, Artificial Sequence; identical to SEQ ID NO: 73
  Synthetic polypeptide

SEQ ID NO: 681 - protein, 166 aa, Artificial Sequence
  Synthetic polypeptide
SEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 682 - protein, 166 aa, Artificial Sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 683 - protein, 166 aa, Artificial Sequence
  Synthetic polypeptide
SEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 684 - protein, 166 aa, Artificial Sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 685 - protein, 24 aa, Artificial Sequence
  Synthetic polypeptide
SGGSSGGSSGSETPGTSESATPES

SEQ ID NO: 686 - protein, 40 aa, Artificial Sequence
  Synthetic polypeptide
SGGSSGGSSGSETPGTSESATPESSGGSSGGSSGGSSGGS

SEQ ID NO: 687 - protein, 64 aa, Artificial Sequence
  Synthetic polypeptide
SGGSSGGSSGSETPGTSESATPESSGGSSGGSSGGSSGGSSGSETPGTSESATPESSGGSSGGS

SEQ ID NO: 688 - protein, 92 aa, Artificial Sequence
  Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 689-690 - skipped (2 entries)

SEQ ID NO: 691 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 692 - protein, 1767 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 693 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 694 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 695 - protein, 1767 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 696 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 697 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 698 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 699 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 700 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 701 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 702 - protein, 1775 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 703 - protein, 1775 aa, Artificial Sequence; identical to SEQ ID NO: 700
  Synthetic polypeptide

SEQ ID NO: 704 - protein, 1767 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 705 - protein, 1767 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 706 - protein, 1767 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 707 - protein, 1775 aa, Artificial Sequence; identical to SEQ ID NO: 696
  Synthetic polypeptide

SEQ ID NO: 708 - protein, 1775 aa, Artificial Sequence; identical to SEQ ID NO: 697
  Synthetic polypeptide

SEQ ID NO: 709 - protein, 1775 aa, Artificial Sequence; identical to SEQ ID NO: 701
  Synthetic polypeptide

SEQ ID NO: 710 - protein, 1773 aa, Artificial Sequence
  Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 711 - protein, 1775 aa, Artificial Sequence; identical to SEQ ID NO: 700
  Synthetic polypeptide

SEQ ID NO: 712-749 - skipped (38 entries)

SEQ ID NO: 750 - protein, 347 aa, Artificial Sequence
  Synthetic polypeptide
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAER

SEQ ID NO: 751-799 - skipped (49 entries)

SEQ ID NO: 800 - protein, 24 aa, Artificial Sequence
  Synthetic polypeptide
SGGSSGGSSGSETPGTSESATPES

SEQ ID NO: 801 - protein, 256 aa, Artificial Sequence
  Synthetic polypeptide
  MISC_FEATURE (5)..(120): May be absent
  MISC_FEATURE (137)..(256): May be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 802 - protein, 166 aa, Artificial Sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 803 - protein, 166 aa, Artificial Sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 804 - protein, 166 aa, Artificial Sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 805 - protein, 166 aa, Artificial Sequence; identical to SEQ ID NO: 684
  Synthetic polypeptide

SEQ ID NO: 806-837 - skipped (32 entries)

SEQ ID NO: 838 - DNA, 24 bp, Artificial Sequence
  Synthetic polynucleotide
cttgggggccccttccccacacta

SEQ ID NO: 839 - DNA, 23 bp, Artificial Sequence
  Synthetic polynucleotide
cttgggggccccttccccacact

SEQ ID NO: 840 - DNA, 22 bp, Artificial Sequence
  Synthetic polynucleotide
cttgggggccccttccccacac

SEQ ID NO: 841 - DNA, 21 bp, Artificial Sequence
  Synthetic polynucleotide
cttgggggccccttccccaca

SEQ ID NO: 842 - DNA, 20 bp, Artificial Sequence
  Synthetic polynucleotide
cttgggggccccttccccac

SEQ ID NO: 843 - DNA, 19 bp, Artificial Sequence
  Synthetic polynucleotide
cttgggggccccttcccca

SEQ ID NO: 844 - DNA, 18 bp, Artificial Sequence
  Synthetic polynucleotide
cttgggggccccttcccc

SEQ ID NO: 845 - DNA, 17 bp, Artificial Sequence
  Synthetic polynucleotide
cttgggggccccttccc

SEQ ID NO: 846 - RNA, 24 nt, Artificial Sequence
  Synthetic polynucleotide
ucauguggggaaggggcccccaag

SEQ ID NO: 847 - RNA, 23 nt, Artificial Sequence
  Synthetic polynucleotide
cauguggggaaggggcccccaag

SEQ ID NO: 848 - RNA, 22 nt, Artificial Sequence
  Synthetic polynucleotide
auguggggaaggggcccccaag

SEQ ID NO: 849 - RNA, 21 nt, Artificial Sequence
  Synthetic polynucleotide
uguggggaaggggcccccaag

SEQ ID NO: 850 - RNA, 20 nt, Artificial Sequence
  Synthetic polynucleotide
guggggaaggggcccccaag

SEQ ID NO: 851 - RNA, 19 nt, Artificial Sequence
  Synthetic polynucleotide
uggggaaggggcccccaag

SEQ ID NO: 852 - RNA, 18 nt, Artificial Sequence
  Synthetic polynucleotide
ggggaaggggcccccaag

SEQ ID NO: 853 - RNA, 17 nt, Artificial Sequence
  Synthetic polynucleotide
gggaaggggcccccaag

SEQ ID NO: 854 - DNA, 24 bp, Artificial Sequence
  Synthetic polynucleotide
gggtgctccacctggtacgtatat

SEQ ID NO: 855 - DNA, 23 bp, Artificial Sequence
  Synthetic polynucleotide
gggtgctccacctggtacgtata

SEQ ID NO: 856 - DNA, 22 bp, Artificial Sequence
  Synthetic polynucleotide
gggtgctccacctggtacgtat

SEQ ID NO: 857 - DNA, 21 bp, Artificial Sequence
  Synthetic polynucleotide
gggtgctccacctggtacgta

SEQ ID NO: 858 - DNA, 20 bp, Artificial Sequence
  Synthetic polynucleotide
gggtgctccacctggtacgt

SEQ ID NO: 859 - DNA, 19 bp, Artificial Sequence
  Synthetic polynucleotide
gggtgctccacctggtacg

SEQ ID NO: 860 - DNA, 18 bp, Artificial Sequence
  Synthetic polynucleotide
gggtgctccacctggtac

SEQ ID NO: 861 - DNA, 17 bp, Artificial Sequence
  Synthetic polynucleotide
gggtgctccacctggta

SEQ ID NO: 862 - RNA, 24 nt, Artificial Sequence
  Synthetic polynucleotide
auauacguaccagguggagcaccc

SEQ ID NO: 863 - RNA, 23 nt, Artificial Sequence
  Synthetic polynucleotide
uauacguaccagguggagcaccc

SEQ ID NO: 864 - RNA, 22 nt, Artificial Sequence
  Synthetic polynucleotide
auacguaccagguggagcaccc

SEQ ID NO: 865 - RNA, 21 nt, Artificial Sequence
  Synthetic polynucleotide
uacguaccagguggagcaccc

SEQ ID NO: 866 - RNA, 20 nt, Artificial Sequence
  Synthetic polynucleotide
acguaccagguggagcaccc

SEQ ID NO: 867 - RNA, 19 nt, Artificial Sequence
  Synthetic polynucleotide
cguaccagguggagcaccc

SEQ ID NO: 868 - RNA, 18 nt, Artificial Sequence
  Synthetic polynucleotide
guaccagguggagcaccc

SEQ ID NO: 869 - RNA, 17 nt, Artificial Sequence
  Synthetic polynucleotide
uaccagguggagcaccc

SEQ ID NO: 870 - RNA, 21 nt, Artificial Sequence
  Synthetic polynucleotide
gacguaccagguggagcaccc

SEQ ID NO: 871 - DNA, 1047 bp, Artificial Sequence
  Synthetic polynucleotide
atgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgcctcctttggtgaaggtgacacatcatgtgacctcttcagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtga

What is claimed is:

1. A method for deaminating an adenosine (A) nucleobase in a sense or antisense strand of a promoter of an HBG1 or HBG2 gene, the method comprising contacting the promoter with a base editor and a guide RNA bound to the base editor, wherein the guide RNA (gRNA) comprises a guide sequence that is complementary to a target nucleic acid sequence in the promoter of at least one of the HBG1 and HBG2 gene, wherein the base editor comprises a fusion protein comprising (i) a nucleic acid programmable DNA binding protein (napDNAbp) domain, and (ii) an adenosine deaminase, wherein the adenosine deaminase comprises an amino acid sequence that is at least 85% identical to the amino acid sequence of a wild-type adenosine deaminase, with the exception of substitution(s) at one or more of W23, H36, N37, P48, I49, R51, N72, L84, S97, A106, D108, H123, G125, A142, S146, D147, R152, E155, I156, K157, and K161 of the amino acid sequence of SEQ ID NO: 1, or corresponding substitution(s) in another wild-type adenosine deaminase, wherein the step of contacting the promoter results in a T-A base pair in the promoter being mutated to a C-G base pair in the promoter.

2. The method of claim 1, wherein the target nucleic acid sequence comprises:

(SEQ ID NO: 838)
5'-CTTGGGGGCCCCTTCCCCACACTA-3';

-continued

```
                                        (SEQ ID NO: 839)
5'-CTTGGGGGCCCCTTCCCCACACT-3';

(SEQ ID NO: 840)
5'-CTTGGGGGCCCCTTCCCCACAC-3';

(SEQ ID NO: 841)
5'-CTTGGGGGCCCCTTCCCCACA-3';

(SEQ ID NO: 842)
5'-CTTGGGGGCCCCTTCCCCAC-3';

(SEQ ID NO: 843)
5'-CTTGGGGGCCCCTTCCCCA-3';

(SEQ ID NO: 844)
5'-CTTGGGGGCCCCTTCCCC-3';
[[or]]

(SEQ ID NO: 845)
5'-CTTGGGGGCCCCTTCCC-3';

(SEQ ID NO: 297)
5'-CCACACTATCTCAATGCAAATATCTGTC-3';

(SEQ ID NO: 298)
5'-CCACACTATCTCAATGCAAATATCTGT-3';

(SEQ ID NO: 299)
5'-CCACACTATCTCAATGCAAATATCTG-3';

(SEQ ID NO: 300)
5'-CCACACTATCTCAATGCAAATATCT-3';

(SEQ ID NO: 301)
5'-CCACACTATCTCAATGCAAATATC-3';

(SEQ ID NO: 302)
5'-CCACACTATCTCAATGCAAATAT-3';

(SEQ ID NO: 303)
5'-CCGTTTCAGACAGATATTTGCAT-3';

(SEQ ID NO: 304)
5'-CCAGGGACCGTTTCAGACAGATATTTGC-3';

(SEQ ID NO: 305)
5'-CCAGGGACCGTTTCAGACAGATATTTG-3';

(SEQ ID NO: 306)
5'-CCAGGGACCGTTTCAGACAGATATTT-3';

(SEQ ID NO: 307)
5'-CCAGGGACCGTTTCAGACAGATATT-3';

(SEQ ID NO: 308)
5'-CCAGGGACCGTTTCAGACAGATAT-3';

(SEQ ID NO: 309)
5'-CCAGGGACCGTTTCAGACAGATA-3';

(SEQ ID NO: 310)
5'-ACACTATCTCAATGCAAATATCT-3';

(SEQ ID NO: 311)
5'-ACTATCTCAATGCAAATATCTGT-3';

(SEQ ID NO: 312)
5'-CCTCTTGGGGGCCCCTTCCCCAC-3';

(SEQ ID NO: 313)
5'-CCTTGTCAAGGCTATTGGTCAAG-3';

(SEQ ID NO: 314)
5'-CCTTGCCTTGACCAATAGCCTTGACAAG-3';

(SEQ ID NO: 315)
5'-CCTTGCCTTGACCAATAGCCTTGACAA-3';

(SEQ ID NO: 316)
5'-CCTTGCCTTGACCAATAGCCTTGACA-3';

(SEQ ID NO: 317)
5'-CCTTGCCTTGACCAATAGCCTTGAC-3';

(SEQ ID NO: 318)
5'-CCTTGCCTTGACCAATAGCCTTGA-3';

(SEQ ID NO: 319)
5'-CCTTGCCTTGACCAATAGCCTTG-3';

(SEQ ID NO: 320)
5'-GCCTTGACCAATAGCCTTGACAA-3';

(SEQ ID NO: 321)
5'-CCTTGACCAATAGCCTTGACAAG-3';

(SEQ ID NO: 322)
5'-GCCTTGTCAAGGCTATTGGTCAA-3';
or (SEQ ID NO: 323)
5'-TCAAGTTTGCCTTGTCAAGGCTA-3'.
```

3. The method of claim 1, wherein the guide sequence comprises at least 15 contiguous nucleotides of a sequence selected from the group consisting of:

```
                                        (SEQ ID NO: 846)
5'-UCAUGUGGGAAGGGGCCCCCAAG-3';

(SEQ ID NO: 847)
5'-CAUGUGGGAAGGGGCCCCCAAG-3';

(SEQ ID NO: 848)
5'-AUGUGGGAAGGGGCCCCCAAG-3';

(SEQ ID NO: 849)
5'-UGUGGGAAGGGGCCCCCAAG-3'.

(SEQ ID NO: 850)
5'-GUGGGAAGGGGCCCCCAAG-3';

(SEQ ID NO: 851)
5'-UGGGAAGGGGCCCCCAAG-3';

(SEQ ID NO: 852)
5'-GGGAAGGGGCCCCCAAG-3';
or (SEQ ID NO: 853)
5'-GGGAAGGGGCCCCCAAG-3'.
```

4. The method of claim 1, wherein the target nucleic acid sequence comprises:

```
                                        (SEQ ID NO: 838)
5'-CTTGGGGGCCCCTTCCCCACACTA-3';

(SEQ ID NO: 839)
5'-CTTGGGGGCCCCTTCCCCACACT-3';

(SEQ ID NO: 840)
5'-CTTGGGGGCCCCTTCCCCACAC-3';

(SEQ ID NO: 841)
5'-CTTGGGGGCCCCTTCCCCACA-3';

(SEQ ID NO: 842)
5'-CTTGGGGGCCCCTTCCCCAC-3';

(SEQ ID NO: 843)
5'-CTTGGGGGCCCCTTCCCCA-3';

(SEQ ID NO: 844)
5'-CTTGGGGGCCCCTTCCCC-3';
or
```

(SEQ ID NO: 845)
5'-CTTGGGGGCCCCTTCCC-3';

and wherein deamination of the A nucleobase that is complementary to the T at position 14 of SEQ ID NO: 845 results in a T to C mutation in the target nucleic acid sequence.

5. The method of claim 1, wherein the guide sequence comprises at least 15 contiguous nucleotides of a sequence selected from the group consisting of:

(SEQ ID NO: 254)
5'-GACAGAUAUUUGCAUUGAGAUAGUGUGG-3';

(SEQ ID NO: 255)
5'-ACAGAUAUUUGCAUUGAGAUAGUGUGG-3';

(SEQ ID NO: 256)
5'-CAGAUAUUUGCAUUGAGAUAGUGUGG-3';

(SEQ ID NO: 257)
5'-AGAUAUUUGCAUUGAGAUAGUGUGG-3';

(SEQ ID NO: 258)
5'-GAUAUUUGCAUUGAGAUAGUGUGG-3';

(SEQ ID NO: 259)
5'-AUAUUUGCAUUGAGAUAGUGUGG-3';

(SEQ ID NO: 260)
5'-AUGCAAAUAUCUGUCUGAAACGG-3';

(SEQ ID NO: 261)
5'-GCAAAUAUCUGUCUGAAACGGUCCCUGG-3';

(SEQ ID NO: 262)
5'-CAAAUAUCUGUCUGAAACGGUCCCUGG-3';

(SEQ ID NO: 263)
5'-AAAUAUCUGUCUGAAACGGUCCCUGG-3';

(SEQ ID NO: 264)
5'-AAUAUCUGUCUGAAACGGUCCCUGG-3';

(SEQ ID NO: 265)
5'-AUAUCUGUCUGAAACGGUCCCUGG-3';

(SEQ ID NO: 266)
5'-UAUCUGUCUGAAACGGUCCCUGG-3';

(SEQ ID NO: 267)
5'-AGAUAUUUGCAUUGAGAUAGUGU-3';

(SEQ ID NO: 268)
5'-ACAGAUAUUUGCAUUGAGAUAGU-3';

(SEQ ID NO: 269)
5'-GUGGGGAAGGGGCCCCCAAGAGG-3';

(SEQ ID NO: 270)
5'-CUUGACCAAUAGCCUUGACAAGG-3';

(SEQ ID NO: 271)
5'-CUUGUCAAGGCUAUUGGUCAAGGCAAGG-3';

(SEQ ID NO: 272)
5'-UUGUCAAGGCUAUUGGUCAAGGCAAGG-3';

(SEQ ID NO: 273)
5'-UGUCAAGGCUAUUGGUCAAGGCAAGG-3';

(SEQ ID NO: 274)
5'-GUCAAGGCUAUUGGUCAAGGCAAGG-3';

(SEQ ID NO: 275)
5'-UCAAGGCUAUUGGUCAAGGCAAGG-3';

(SEQ ID NO: 276)
5'-CAAGGCUAUUGGUCAAGGCAAGG-3';

(SEQ ID NO: 277)
5'-UUGUCAAGGCUAUUGGUCAAGGC-3';

(SEQ ID NO: 278)
5'-CUUGUCAAGGCUAUUGGUCAAGG-3';

(SEQ ID NO: 279)
5'-UUGACCAAUAGCCUUGACAAGGC-3';

(SEQ ID NO: 280)
5'-UAGCCUUGACAAGGCAAACUUGA-3'.

6. The method of claim 5, wherein the target nucleic acid sequence comprises (SEQ ID NO: 297)
5'-CCACACTATCTCAATGCAAATATCTGTC-3';

(SEQ ID NO: 298)
5'-CCACACTATCTCAATGCAAATATCTGT-3';

(SEQ ID NO: 299)
5'-CCACACTATCTCAATGCAAATATCTG-3';

(SEQ ID NO: 300)
5'-CCACACTATCTCAATGCAAATATCT-3';

(SEQ ID NO: 301)
5'-CCACACTATCTCAATGCAAATATC-3';
or (SEQ ID NO: 302)
5'-CCACACTATCTCAATGCAAATAT-3';

and wherein deamination of the A nucleobase that is complementary to the T at position 21 of SEQ ID NO: 302 results in a T to C mutation in the target nucleic acid sequence.

7. The method of claim 5 further comprising deaminating a second A nucleobase in the sense or antisense strand of the promoter using a second gRNA comprising a second guide sequence that is complementary to a second target nucleic acid sequence, wherein:
(a) the second target nucleic acid sequence comprises SEQ ID NO: 845;
(b) the second guide sequence comprises at least 15 contiguous nucleotides of the sequence of SEQ ID NO: 853; or
(c) both (a) and (b).

8. The method of claim 1, wherein the guide sequence of the gRNA comprises at least 15 contiguous nucleotides of the sequence (SEQ ID NO: 270)
5'-CUUGACCAAUAGCCUUGACAAGG-3'.

9. The method of claim 8, wherein the target nucleic acid sequence comprises 5'-CCTTGTCAAGGCTATTGGTCAAG-3' (SEQ ID NO: 313);
wherein deamination of an A nucleobase that is complementary to the T at any one of positions 15, 16, or 19 of SEQ ID NO: 313 results in a T to C mutation in the target nucleic acid sequence.

10. The method of claim 8 further comprising deaminating a second A nucleobase in the sense or antisense strand of the promoter using a second gRNA comprising a second guide sequence that is complementary to a second target nucleic acid sequence, wherein:

(a) the second target nucleic acid sequence comprises SEQ ID NO: 845, SEQ ID NO: 302, SEQ ID NO: 303, SEQ ID NO: 309, SEQ ID NO: 311, or SEQ ID NO: 312;

(b) the second guide sequence comprises at least 15 contiguous nucleotides of a sequence selected from the group consisting of SEQ ID NO: 853, SEQ ID NO: 259, SEQ ID NO: 260, SEQ ID NO: 266, SEQ ID NO: 268, and SEQ ID NO: 269; or (c) both (a) and (b).

11. The method of claim 1 further comprising deaminating a second A nucleobase in the sense or antisense strand of the promoter using a second gRNA comprising a second guide sequence that is complementary to a second target nucleic acid sequence, wherein:

(a) the second target nucleic acid sequence comprises SEQ ID NO: 845, SEQ ID NO: 302, SEQ ID NO: 303, SEQ ID NO: 309, SEQ ID NO: 311, SEQ ID NO: 312, SEQ ID NO: 313, SEQ ID NO: 319, SEQ ID NO: 320, or SEQ ID NO: 321;

(b) the second guide sequence comprises at least 15 contiguous nucleotides of a sequence selected from the group consisting of SEQ ID NO: 853, SEQ ID NO: 259, SEQ ID NO: 260, SEQ ID NO: 266, SEQ ID NO: 268, SEQ ID NO: 269, SEQ ID NO: 270, SEQ ID NO: 276, SEQ ID NO: 277, and SEQ ID NO: 278; or (c) both (a) and (b).

12. The method of claim 1, wherein the step of contacting the promoter leads to an increase in transcription of the HBG1 gene or the HBG2 gene.

13. The method of claim 1, wherein the method is performed in a cell of a subject who has a disease or disorder of the blood.

14. The method of claim 13, wherein the disease or disorder is caused by a mutation in a gene, or a promoter of a gene, selected from the group consisting of CYGB, HBA1, HBA2, HBB, HBD, HBE1, HBG1, HBG2, HBM, HBQ1, HBZ, and MB.

15. The method of claim 1, wherein the adenosine deaminase comprises each of the W23R, H36L, P48A, R51L, L84F, A106V, D108N, H123Y, S146C, D147Y, R152P, E155V, I156F, and K157N substitutions in SEQ ID NO: 1, or the corresponding substitutions in another wild-type adenosine deaminase.

16. The method of claim 1, wherein the guide sequence of the guide RNA comprises at least 15 contiguous nucleotides of a sequence selected from the group consisting of:

```
                                   (SEQ ID NO: 254)
5'-GACAGAUAUUUGCAUUGAGAUAGUGUGG-3';

(SEQ ID NO: 255)
5'-ACAGAUAUUUGCAUUGAGAUAGUGUGG-3';

(SEQ ID NO: 256)
5'-CAGAUAUUUGCAUUGAGAUAGUGUGG-3';

(SEQ ID NO: 257)
5'-AGAUAUUUGCAUUGAGAUAGUGUGG-3';

(SEQ ID NO: 258)
5'-GAUAUUUGCAUUGAGAUAGUGUGG-3';

(SEQ ID NO: 259)
5'-AUAUUUGCAUUGAGAUAGUGUGG-3';

(SEQ ID NO: 260)
5'-AUGCAAAUAUCUGUCUGAAACGG-3';

(SEQ ID NO: 261)
5'-GCAAAUAUCUGUCUGAAACGGUCCCUGG-3';

(SEQ ID NO: 262)
5'-CAAAUAUCUGUCUGAAACGGUCCCUGG-3';

(SEQ ID NO: 263)
5'-AAAUAUCUGUCUGAAACGGUCCCUGG-3';

(SEQ ID NO: 264)
5'-AAUAUCUGUCUGAAACGGUCCCUGG-3';

(SEQ ID NO: 265)
5'-AUAUCUGUCUGAAACGGUCCCUGG-3';

(SEQ ID NO: 266)
5'-UAUCUGUCUGAAACGGUCCCUGG-3';

(SEQ ID NO: 267)
5'-AGAUAUUUGCAUUGAGAUAGUGU-3';

(SEQ ID NO: 268)
5'-ACAGAUAUUUGCAUUGAGAUAGU-3';

(SEQ ID NO: 269)
5'-GUGGGGAAGGGGCCCCCAAGAGG-3';

(SEQ ID NO: 270)
5'-CUUGACCAAUAGCCUUGACAAGG-3';

(SEQ ID NO: 271)
5'-CUUGUCAAGGCUAUUGGUCAAGGCAAGG-3';

(SEQ ID NO: 272)
5'-UUGUCAAGGCUAUUGGUCAAGGCAAGG-3';

(SEQ ID NO: 273)
5'-UGUCAAGGCUAUUGGUCAAGGCAAGG-3';

(SEQ ID NO: 274)
5'-GUCAAGGCUAUUGGUCAAGGCAAGG-3';

(SEQ ID NO: 275)
5'-UCAAGGCUAUUGGUCAAGGCAAGG-3';

(SEQ ID NO: 276)
5'-CAAGGCUAUUGGUCAAGGCAAGG-3';

(SEQ ID NO: 277)
5'-UUGUCAAGGCUAUUGGUCAAGGC-3';

(SEQ ID NO: 278)
5'-CUUGUCAAGGCUAUUGGUCAAGG-3';

(SEQ ID NO: 279)
5'-UUGACCAAUAGCCUUGACAAGGC-3';
or
                                   (SEQ ID NO: 280)
5'-UAGCCUUGACAAGGCAAACUUGA-3'.
```

17. The method of claim 1, wherein the method causes less than 1% indel formation.

18. The method of claim 1, wherein the efficiency of deaminating an A nucleobase is at least 30%.

19. The method of claim 1, wherein the guide sequence of the gRNA comprises 1, 2, 3, 4, 5, 6, 7, 8, 9, or 10 nucleobase changes relative to SEQ ID NO: 270.

20. The method of claim 19, wherein the nucleobase changes comprise a deletion of one or more nucleobases of SEQ ID NO: 270.

21. The method of claim 20, wherein the gRNA comprises the nucleic acid sequence 5'-CUUGACCAAUAGCC-UUGACA-3' (corresponding to bases 1-20 of SEQ ID NO: 270).

22. The method of claim 20, wherein the target nucleic acid sequence comprises a 3' end that is not immediately adjacent to a protospacer adjacent motif (PAM) site.

23. The method of claim 1, wherein the guide sequence of the gRNA comprises 1, 2, 3, 4, 5, 6, 7, 8, 9, or 10 nucleobase changes relative to SEQ ID NO: 260.

24. The method of claim 19, wherein the nucleobase changes comprise a deletion of one or more nucleobases of SEQ ID NO: 260.

25. The method of claim 24, wherein the gRNA comprises the nucleic acid sequence 5'-AUGCAAAUAUCUGU-CUGAAA-3' (corresponding to bases 1-20 of SEQ ID NO: 260).

26. The method of claim 24, wherein the target nucleic acid sequence comprises a 3' end that is not immediately adjacent to a protospacer adjacent motif (PAM) site.

27. The method of claim 2, wherein the target nucleic acid sequence comprises a 3' end that is not immediately adjacent to a protospacer adjacent motif (PAM) site.

28. The method of claim 4, wherein the target nucleic acid sequence comprises a 3' end that is not immediately adjacent to a protospacer adjacent motif (PAM) site.

29. The method of claim 6, wherein the target nucleic acid sequence comprises a 3' end that is not immediately adjacent to a protospacer adjacent motif (PAM) site.

30. The method of claim 7, wherein the second target nucleic acid sequence comprises a 3' end that is not immediately adjacent to a protospacer adjacent motif (PAM) site.

31. The method of claim 9, wherein the target nucleic acid sequence comprises a 3' end that is not immediately adjacent to a protospacer adjacent motif (PAM) site.

32. The method of claim 10, wherein the second target nucleic acid sequence comprises a 3' end that is not immediately adjacent to a protospacer adjacent motif (PAM) site.

33. The method of claim 11, wherein the second target nucleic acid sequence comprises a 3' end that is not immediately adjacent to a protospacer adjacent motif (PAM) site.

34. The method of claim 1, wherein the adenosine deaminase comprises one or more of W23L, W23R, H36L, N37S, P48S, P48A, I49V, R51L, N72D, L84F, S97C, A106V, D108N, H123Y, G125A, A142N, S146C, D147Y, R152P, E155V, I156F, K157N, and/or K161T substitutions in SEQ ID NO: 1, or one or more corresponding substitutions in another wild-type adenosine deaminase.

35. The method of claim 1, wherein the adenosine deaminase comprises one or more of W23R, H36L, P48A, R51L, L84F, A106V, D108N, H123Y, A142N, S146C, D147Y, R152P, E155V, I156F, and/or K157N substitutions in SEQ ID NO: 1, or one or more corresponding substitutions in another wild-type adenosine deaminase.

36. The method of claim 1, wherein the adenosine deaminase comprises A106V and D108N substitutions in SEQ ID NO: 1, or corresponding substitutions in another wild-type adenosine deaminase.

37. The method of claim 1, wherein the adenosine deaminase comprises an amino acid sequence that is at least 85% identical to any one of SEQ ID NOs: 65-83, 420-437, 672-684, and 802-805.

38. The method of claim 1, wherein the adenosine deaminase comprises the amino acid sequence of any one of SEQ ID NOs: 65-83, 420-437, 672-684, and 802-805.

39. The method of claim 1, wherein the napDNAbp domain comprises the amino acid sequence of any one of SEQ ID NOs: 34-36 or 417-419.

* * * * *